United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 8

SEQ ID NO: 5804 - DNA, 22612 bp, Homo sapiens
ctcttgagctccttgctggagcccaatcccagtctgtggagtgtactttcatttaaataaatctgtgcgttctttgcttcattctttcattgcttggtttgtgcattttgtccagttccttgttcaaaatgccaagaacctggatgactcatagtcaagaccctccaccagtaacatatattggcgagccagccaggagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgcatgtatccaggctttggtgctgctgtcctaagaagggtcaggcctagtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaaaagcactcataaattaaataaataagtccaagcaattttcaagttcatgtgacttaagtaaatcttcattaaatagctggctttaaaattattggtaaaatgaaaatagaaatatcttcagaattgtcagcatacatttttgtctgggttttatatttgtctttgctagaaatgttgaagtgtcagcatttggcatagaagattataaagctattaacccagccaaaacaaaatggccttagtttatgtggcttctttgacaaatgagactaatttaatattgttagctaaatcttctgggttattggcaaaaacacctatgtatttaactgtgaggttcttatttaggtgaacacataatgttcattggctattaaaaatggttaacaaataaataactaactttaaatgatggtgtctaatatctcagttttcagaagtaatctagataaactgttaaaaatgaaagacttaagtacatgtaaatgggatgaatgattaggtaaattttgtgtaatttaaaatcttaaaagtatttttgatgcccattggatatctcagtcatttccaattaagaaagggttatgatagggaggaatatgtttccaaaaattgtggaattattctcatctataaaatgctaatatctgatagtttaggattttttgcttcctaaggtttcactaaaatttaaggttactaagatgatatggtttggctttgcatccccacccaaatctcttcttataactcccataattaccgtgtgttgtggggagggatccagtgggtgagagatgattgaattatgctgttctcatgatagcgaatgggtctcatgagatctgatggttttgaaaatgggagttgccctgcacaagctctccttttgcctgctgccatccacataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcccgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattacttttaccttgtttcataagttttaaatagccttgaattagataaaaaattattttcctttaaataagaacacatttctttttttagaaaaatatttttctgtaattttttttttttcttgagacagagtcttgctctgtcacccaggctggagtgcagtggcacaatcttggctcactgcaagttctgcctcccgggttcacgccatcctcctgcctcagcctccagggtagctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggtttctttttttttttttttgccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcctccagttctagacttctaatttcttgatcttattaccctaggcagttgtcagctaagataaccctaaatttgcatattaaaggaactcttagatgaaaaaaatcagatagtgaaatttacatctcaaggtacagagagaaagagtctggtgctagtgtttccagaatttattccttctggtgggttcttggtctctctgacttcaagaaagaagcctcggaccttgcagtgagtgttacagctcttaaaggtggcgtgtccagggttgtttgttccttctggtgggtttgtggtctcacttcaggaatgaagctgcagaccctcatggtgagtgttacagcaattaaaggtagtgtggacccaaagagtgagcagcagcaagatttattatgaagagcgaaagaacaaagcttccacagcatggaaagggacctgagcgggttgatgctgctggctgtggtgaccagcttttattcccttattcgtccccacccacgtcctggtgattggtccattttacagagcactgattggtccatttcacagagtgctgattggtgcattttacagagtgctgattggcgcatttacaatcctttagctagacacagagtgctgattggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaaatcaaacataaaattatagaaatctatcataggattatattagaagactgactttatttatataagtagttctaaatttagtctgccttttaactggatctctgagctctgggcagagcccacactgaattccgggtctccaaaaagagaattattatgaggctaagaccatgtgatggttttatgagtgcactctccttttttttttttttttaacaaaaatgtttctctaagtgtctgaactactctcttcctaactttaaacacccaacagtaacctctgttgttactctttgactaaaataattattttagttaaaaaaaaaaaaaaaagaagaaagaaagaaaccaggtaacactatacaaaaggaagcagtgtaagatctgagacgaaattttctcttttacactctttgagttccataaggagaaacagaggttgctccccaaaagggagtctagtgccttctctgttttctttaaggaatcccagggtgttagaaactattttagattcctcatgcagcacagggtagcaagagaaagaagaggcagcagaagtaaaatgaagaaaacagaatttggttgacggagaagaaaaaaacttttgctcaaaaagttgaaggagagaaataaaaaaggccttaactacacacacacacacacacacacacacacaccttggatgttagcttttatttaagcttttagccactaagctccttaaaaaaaataccttcaaatctcattactgtattttagctagtacaaactgctgatatttcaaaagtaatgcaaataccaaaccagaaagggcttgatttaggaaccaaacttaggcagtcatgatgaaaataaggacagaatcttagtttccaaactgcagtgctgggggacaaccattgctctttcagtttggcctggttagcaaaagatggccttgttatgtaaataaagcccctaaggtagtcaaaatcaaaaaaaatttttttttccttttgctagctgtttttttcttttttctttttcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacagttaaaagaatattggcagagaaacagccttggtgttccagcaggagtgaagaggaacaggaaaacgagtggcagtagccctgaaacagccacttctggtggttgccactcacctgaggatgtgagtcttggcaggccaggcttctggggacagggggcccaaggcacagtagacggtaatttttaagattatggatggactgttgggtactggttaagaattctgggtttggccaggcacagtggctcatgcctgtaatcccagcactttgggagactgaggccggtggatcacgagctcaggaaattgagaccatcctggctaacacggtgaaaccctgtctctcctaaaaatacaaaaaaattagccaggcttggtgatgggtgcctgtagtcccagctactcgggaggctgaggcaggagaatggtgtgaacctgggaggcggagcttgcagtgagttgacattgtgccaccacactccagcctgggagacaaagcgagactccatctcagaaaaaaaaaaaaaaaggaattctgggtttgaatcctgcctctccgtctgctagggatatgatttagggcaagttgcttgagctctttgggcctctcttattacatctgcataatagaggtggtattgtttgacttccatttgtgaagtttaaatgagatttttttattgttgtttttatgttaatccctagtacatggcctgctgtaaacacccaggacacccaggatatggtcattgctctttgattttcctcatccccagtctcaaggggaagccaggacaatgagaacagccacttgccatcaagagtcactgaaagggcctcagggtgggatggtggggggataagaaccatgagagaagtcggcacaaaggagttatgggacaaagcgtccaagataggcagaaaagaaaatgtagccagttgatggggaagaaaggaagtcagagggcttagacactgagggggacagaacatctccatgtgcattctcatctctggtagtcagcaacaggtatccacggggagggccctacatcatctgctaccctgaaggatctggaggtaagaggctctggggagaggtgcagtgaccctgcaggccagccctccaacctcctcccacagtggacacggcatgcccctctgccagctgagacagcccacacacaccccagccttaatgattgttctctctacctctcccccactcctcctccacctcctcgtctctgcatgcacctcagagcccatgccaagaactagcagtagtcctggacccgaggtccataaaaatcagtcaactgaataacaccatcaaatctttggtaagagtccagtggggtccccttattccacgctgccaatcctgggctccagtttccccttggggccctgaggaaaggagctgggggcacctggtgccaaggacaaatagggaactggggcgcccaggcctcacctagagggaccccagagcatgcagtatggctcttcttttgctgccctctttgccgactctctcttctccagacacccctggagaggggtataaacacctttgttttatcaacccaaagtgccattgatttaaagacacctctatttgagaaatgttggaaatcgtatgtcttagaattgatcaaatacaccagaatgtgagctgaaaagaaagcaccggacttaaaatttaggaagtcactggtgatcttacttggagaaatccatttcagtagattggtaagtgcagcactagatggctgtgagttggacaaatgggaggtgtggcattgtatgcagcagagatgcatggatggtgtgcagaccagtattgcaaaaaaattgtggtgatgggaagatgtgataaagctcaagatgtggtacgatttaaaggaaggtaatttttgtatgaggacaacttgagcctttgtcaaggctaaggagaagaagctgatggagagactaaaggagtatatgaggcgctgtggaaatagattagtggagggggcatagatatgaaattagtcagggctggccttaagtgtaactttttaacttattagctgacgttggacatctcacctctgtgagctcaggaggctcacaatctcctgagctttggtctcctcaattgtaaaagtgagttaatcatttccctaccttatggaactgttgtttgtattaagtaatttatctacataaagttcttggaacattatggtcaggacatagtagatactcaataaatggggtctactattatgaagtagatactcaataaatgggatctactattatgagactacgagagacagcataattgattagccacgtccaggtgggaagggatgggatcaagctcacaggttgaagaattcaccctgaaaaggaagagaaatccctctgtggtggtttgaaaagatgtccacagattctttgctatcccttccttcaaaagataggatctaattcctctcttcttgagtgcaagggatgcttaatgaattacctctaaataatagaatgtggttgaaatgacaatgttcagcttttgagagtaagttgtaaaaggcatgtgacttactccatgcttcttctcttggatcacacaatctggaggaagccagctgacttttcacttgaacactcaagcactctctggggaggtgccgggcagtgagggactgaggcctcctgccaacagccatgtgagtacaccatcttggaagtgaagcctccactcctagtctagctttcagatgactgcagccccagctgatatcttgtctgcaacctcatgaaagactctgtactagaaccactcagctaagcaacctccaaattcctgactcacagaaactatgagataacacatatttgttcttttaagctgctaagttttagggtaatttgttacaaagggtaacatatacagattttctctgaggcagaaggaaatcagagaatgacaggtgaaagatgaaaagatagaaaggaaaaaagataaatgtttctgtaacattaaaatatgaggtatgttgtctgctgacaatgaggtggcttggcaagactgctaagagattggaacagccaggcagaaaacaggaaagggaattaacttggaacacaaataagattgagcctacctacctttatgctaaacccaactacagaaatcattttgctaatggaaccagatcagactccacataatgagtctttatctcaatcgtgaaattcagaggctgggggcctctctgagcctaccccagagaccacctttgtgagcaaactgctaatgagtgaattcagggatgaggatggctcaggcttatcttgaaaagtactccctgatgtcaaaatgatttgctacagctacatcaagtctagcacattatttatgaatagggatagactaccagaagtattgtaagagaataatcaacaagtcttatgtaatctgcagcaaacatactgcagtaacaggaaaatccactgtctttcaaatgactcaagtttgcattattccttcctgtttggactgtctctctctctctctctctctctctctctctctctctctctctctctctctctctctctctctctccttctctctctctctttctctctcccttccttcctgcctctctccactctggctgctagcaagagagccctgggaattctctgtgatgtagccagccaacagtttttagggtggtgctccagcacataaaagggaccaggccaggactgccatctcctaaagttaatttaaagaaactaagccctggtttttgtaaaccccacaggtcaaccaggaattgagtcactgcatctccctgcagaatgacaaatcatgctctccttagtagctttacaccagttctgtttgcaaattggggaactgaaacatcactgtaaaattggtgccttttgtatcttatacaatagggctcattcattcattcaccctttcattcactcagctgtttatttagcaactgattattgagtgcctcttccatgaggggacaggcatgtactaattttgggaataaagagatgtatattgtgatcctaaggagaagcaaaatgtcctggcacatagtaagcactcaataaatatatattgaataaataataattcctgctctctctgggcatcatagtctagtagggggaagaggcatgtaaacaaataaagttgttttagtacaatagtaaaggaatcgatcaagtactatacatgtagaataccatatctacctggaagttagggatgatttgatagaagaggtaacatttgcttgatgttgaagaacaaatatgagttttccaggaatggaaagtaggaaaggtctttgcaggcagaccaaaattattatactcataggtcttattgtccgcgggattggttttgtcactcctgtctaatcctaacttgcaaatataaatatttatcaatatttccctggattttaattgtttttgtgtttgtttccaagacagtgataggtggtcaaagttagatgcaaaataactctacaaaagagattattttttacaaagtagatgacattaattcaagaaaaaaagtattttaagtttcttcctgaaagaaccttttaatttcttgtattttctaggccaggtggaagatattcttcctaaaaaatggtcttcagattacctctaaaccttcctctttgacacctggctgagaacccagaaaacaccccctgttccatagcagaccagtgtttactgttatttgcctctttagagcagttcagaggaccatcagctaccatacccactaaacgaaaatggcaaaaggacttgtaatggccaaatgcagcaatataatttgttattatcaattcactagtgatttgaaatattgagaaaattcccaattgaatgacagcatggaaaatcacattacatcagggaatagtattttctaggccaccagatttctctaaattggaatttggaaataaattttatttgcagcaagaaacatgtattaatactgacacttactaaaatgttttaatgagttagagcaagcattttgtgtcaagatactactggtctaacaaggcctgccactattattgatgcccattatgtacttttccgtgaagttgtctaacctgttctattaaacccgtaaactgctttgacaatcgtaaaagagacaaaaaggaacaaagtaagaatgatgggaaatagaaagccaaggcacccaattttcttctagtttaatcaataatttggggctctatcacatttgctctcagccttacagtctgatccttattttttgccaggctgcaaccctcactgcatttaatagaggttgatggatatttttatagccctgcagtttcaaactgattatcaggtgtttaaccagcaaagccatgcaatatttgtataaatcaatcctgtaatgaaaggttatcacccacaaacccagtcagtgtcaaaccagaacaaggtaaagatttggaatgcttccctttctggataacacactattgcttatcttcaattttctggataatttaggattttattgaatatgattcttcaagaactgaacgatcatcctaaacaaatcaaagtcactgtatcatcacagagcagcatttcccacactctcagtaaaacgctgtctacatcaaaggggttctgtgacccaggaggttttggaaactcaggattaaacagagctccacaggttcccttgctacaggcattctcagctgccttcataaggcgatgtgcattgtgaatctctaagtggaaatatggaatgcagtgttttccaggtcactggaccacagaagccttgtttgagaatcacctagtggccccagtggcccacagatcatattttgggaaatgttgctatttgagtataattgttattcttgaacaccccaaattgttttggtgtgggattttttgttttgctttgtttttgtttttgttttgagacagggtgtcactctatcacccaggctggagtgcagtggtgcgatcactgctcaccacagcctcgatcacctgggctctggtgatcctcctgtctcagcctcccaagtagctggaactacaggcatgcattaccatgcctggttcattgttttgtattttttgtagagactgggttttgccatgttgcacaggctggtcttgaagtcctgagctcaagcaatccatttgcctgagcctcccaaagtgctggggttaccggagtgagccactgcgcctggctaggtttctcatttttttttaaaggtgaaattcacataacataaaattaacgattttaatgtgaacaattcagtggcatgtagtccattcacattgttgtgcatccaccacttctatctagtattaaagcattccatctccccaaaataaaactctgtacctgatgagtagttaatttcctattccctctttcccctagcccctagtaactaccaatcagctttctattcctatgggtctacctattctgcatatttcatataaatttaatcaaccagtatgtgacctttcatgtctggtttctttctaatagcagcatgctttttagtttcatctacattgtggcatacacctgtgcttcgattctctttatggctgcatgacgttccattgtatggatagaccacatttgtttgtccattcacccattgacggtcatttgttttcacctttggaccattgtgaatagtgctgctatgaagactcttgtcccagtattttgtttccaatttgtttggggatacacctaggtgtggaattgctgggttagagaattcatcttgccactacaattttgtggcttcctaaggcaaattgaatagttcgtatgacttagctagcttgagacatcatttttaataccttttgttgttgttgttgttttgttttgttttttcagagatggagtctcgttctgtcacccaggctggagtgcagtggcgcaatctcggctcgctgcaagctctgcctcccggattcccgccattctcctgcctcagcctccctagtagctgggactacaggcgccccccaccatgcccggctaatttttgatatttttagtagagacagggtttcactgtgttagccaggatggtctcgatctcctgacctcgtgatccacctgcctcggcctcccaaagtgctgggattacatgtgtgagccaccacacccggccccatttttaatacgttttttaaagatgcatataaaatgcattaccctctggaagattccagtaacttactgaagcaagtttctcctctacatatacctatttctgccatgagtaactgttcattttcagtgagtcatttgagtttctgttattcaggtatacagagttcctgttgtctttttagtcaacaaagtttaacaaagaccataataaagatggctttcagcagctctgttattgggaagggttgtattcatgtgaagaaagaaattattttattttatttttaagttttagtagagggggggttttgctatgttggttaggctggtctcgaactcccatcctcaagtgatccacctgcctcggtctctcaaagtgctgggattacgggcatgagccactgtgcctggacagtaataatattttttaaaaggctgacatcagcagatcagctattctggaaagatttttaaacactcagaggtttttttgtgtttgtttgttttcttttcttttcttttttagaggcagggtcttgctctgtcgcccaggctaaggtggagtggtgcaatcatagctcactacagcctcaaactcctgggctcaaacaatcctcacacctttcataccttaggcccctgagtagctgggtgggactacaggcatgcatcaccatgcttggctaatttttaattttgtataggtggggtcttgccatttgcccaggctggtgtcaaactcctcaagtaatccttctgcctcggcctcctaaagtgccaggattataggcctgagccactacacacagcccggagtttttaaaaaatactcaattaaaatgcttcatttaagtgtatgtctctaagaaaatttaataattgattaaatattgttgaatagactgaaagcacaacatccaagcacatgaattaagcaaataatgcaagcatagctcccacactccacaaatgttttctagtcattccaaagccattctttttagaggatctttaagaaaatgcttggctctcatccgattattatacaagagattaagaatttactgagtttacagttctttctatgaaggaaagaatgaggtctacacccaaaagaaacattgggattttcatttaagtaaagctgtattctcatttaaaatggtactagtgctcttgttggcaacagacacatgaagcaaaattttccttttacatttgaatttcaactgcatttaaagtgttataaataccatgactacataagctaagggaatgaatgtattaactctgatgcagtctgtcaggttttaacagtagtgaatcttgggatcggtacatctcattccagtatagctatggtaaatgacatagagatcgctgaattgttgtatttccaggacttttcaaaagtgactattaaggttggctgtgggatctagcaggttattgtcctagaacacttgtggccttctcctaaaacagactgggaaaattctggttctttattcactgacatctcaaagggcaaagagggaggcaccatgacattctgcagttgcaggcctctcaggatgagactgtatttttccatacagcaatgttgatttgatctggcctaattctccgattgatgtggtgagaggcaggactacttgggaatgtattcactgtgcctgatttctctctgggcaatttatttggtcatcaatctttttatcctcctgacatttgatttctagatattggcccaaattccataagataggaatttttgttctgaattttaataacatatgtattttaattaatagtatattttaaaataaaagtaacacgacaaaaagaaaaaacaaagacaaaaaagtaacctaagaatatatgctcaaaagtgccaaaaatacaaaagactacagaatttttaaaatagaagctttttgttcaacttgctgctcttcttcccacttcttcaattccatttcttttcctataggtgatcatggctaacattttggtgtttgtctttccaaagtgtatagttatagatctgaatagaaatgtagatacagagatatcaaagatgagcatgggctaagcactcaacaataaactacgttgggtctatttttcaaagttactctcaaaacaagaatacagattgtccattaaacatactggaattttaatacattcttttttttcccccagaacatttctgatttcatatattctggcatgtttcctgccatgtggcaaaccataagctgaaagagatataaatataaataacactatgtctaacaaaatttgctcagaatatgctaaagcattagtataaatgtctacatcttaagtcagagctaaagaacaagtttctctcagtaaatcaaggaaagccaggggaaaagaccatagagaaaaaggatatgggtgcctgtatgaagcaggggaggtttttgactccagtgcacctaattagcaaataagtatcattcatctgtgctgtggtaagcactgcagtatgcataaatagaaggtgtgatacctgcctccaaagggcttaccatctactgagaaatccgactaatcagacaggaaagactcagataatgaaggcttgcataagagcctgaatctgataaggtaatgaacaaaagacagcctctacaggtttttatagatagaaatgagatgataaaatcaaatttaaacaatgtatcttaactcccttccggcctttcatttccattccatgaatgctaccctggcttaggctttcatgactttgcctatttgcagtgaccttgtattcagcactctgccatctctcccactacttcctcccaagccatcctgaacacaggccacatgtttgattttctaatcgtacacaagggaacgtctctgctcaaaagccaaaaatgactcttctttggccaccaaataatctgaactttttggtgtgaaactcaaggccctgccagaaacaatattaatctccttccagactgtctcccatttcctaatattaaccccttgctctgttgaaattgaagccattttccaaagccacctctgtgatgtccttatgtaattcccgccctcttcttgtcctcccctgcaaccctatctccatagaaaagcagtcagaaaaaccaccctaggaattgatgcagtaatccaggagtgagatgaggatgggagggagagggtgagcatgtggggatgaggaggagggtgggacacagggagtagccacagaccttaatgactgatggcagatagggtgtgaaggagagaggtgagtcaaaggtaacttattttcggttttaggcaacaaatacaaatctttctcaataactactcatcccacatccttgtggctattggaggttgatatttatttcatactgcctgtataacctgggaccatatataattaatgatgattactctgtattctagatcacgaatatatatatctatataaatatatacaaatatataaatacaaatatatatatatatatatatatatttaccttaatgcaggcacaaccaaatactttacttttggagccagatgtctttaagatacactgtaaaccattaatagatacattgaataagaatctttatttcattcccagtgtggtttggagtataagacttaggaaagtgtctgtgaaacctacagtgagaaattccactgggtcttgacagctggagtgagcactcaaatgtgcccagcacttttctctagctcccttctctgcttgagctgtggtctgctttctccttctctgtagctcagatcatcttcctccacttctcagcccacatgtctaacgtggctgggaccagctcagagtgtttcaaatgtgtaggtgctcggagagagagagacccaaccctcttagactcaggtacacattctcagggaagaaaactggaaccagtagaaatatcagatccctatgttccctgacgagtgcttccttctctaagaagaaaaacctactaagaagacaaattacagctggaaggttgtttggtaagcgtggaatcacctatctaatctcccagcaagtcttaattgctctaccataaaaaaaaagcaacccaaatccatccttttcccagcttcactccctagtccaaagccaccatccacccttgtctaaacctctgcaggactgtctttgcttatttcttttcttttctttttctttttcttttttttaagcggagtctcactctgtcacccaggctggagtgcagtggcgcgatctcggctcactgcaagctctgcctcccgggttcacgccattctcctgcctcagcctcccgagtagctgggagtacaggcgcccgccaccatgcccagctaatttttttgtatttttagtagagatggggtttcactgtgttagccagaatggtctccatcttctgacctcgtaatccacccacctcagtctcccaaagtgctgggattacaggcgtgagccaccgcacctggccctgtcttttctaatttcttaactatcatttctatccccttagaattgattctccactcagcatgcagaattatccctttgaaaatcagattatattcctacctaaaccacccccaatagcttgtgacctcttagaatctagattccttaacatggcctcaagggcccacgtgacccagcccctgcctgtctctctacctcatctcctactgctcctgcttttgttccttccactctaatcacttgacctcctgacctcagtcatgctaataaactcatgcctcatttagatttattttcctagtggaagaaaatgcattgatctgtgaacacaaatacatggtttatctgttacagttctcattgcatgtcaacaaactgacattctgatgtgtacatccatctcttatgagtctgcttagtgtgaatctgccccctctggtagtactgacaagattgtgtttctcagcccacagagctaagacacagactcatgagacccagtctctgtctataccactagagttctactgcccctgaatggcattgcctgcacagacagctggccttcctcagcagacacacagcctttgtaccatataactcttcagacttgctatgatgtaccaatgtctttccttgaaatgctcttctgaaaatgataaatgctaaaactgattacaatgctattgaaagtggatgagcaagttgatctgctgagatgtgaaaacaaattctattttaatttttaatctaaaatattagaaagaattttgtttcctatactttgctatatttagtaaatatacactaatataagaattttgctttactaaaacagtagaaccctcagttagccaggcagtcatcatctgtcacataaaaggtgtcctgaggaggaatgggagtgcctcccctggggaagaggctgatggtggctctggctctcagtcagtcgctttccttatcttggtatttactgtcatttatctgggcttagctaaacagatttatagagaattaactctcacaaaatgggaacataatttaaaagatttctgcaaagaattggacaggaactcttgtcaaaattgtaagcagaagaaaagaaaaaaagaaagggacagagccgacatttctcatacttctggtacaagctcctcatcacattcattgtgttgtaaaaataatggtgatctagtaacatctgacaaggtcagccaaaatgatacatataagaatttagctctccacctaggagggctattagcaataaaatttccatctactataacttataattaactttgacctatatgtgtatttcccttgagattggccaatgattgattgaaactaccacaattaatgacagataaaatagcttttttattttaaaatttctattttgtgggtattatagaatgtattttatatattaatatacatataattatatactattataatcatatattaatattaacatataattgtgtgtgttcaaaaatttttaatggcacaatcaaaaaactttaaagaccactggattaaaagatggtatttagggcccagcacaatgactcaagtctgtagtctcagcactttgggaagctgaggtgaggggatcgcttgagcccaggagatcaagaccagccatgggcaatatggcaaaaccccatctctacaaaaaatacaaaaattagccagatgtgttgcaactgtagtcccagctattcaagaaactgaagtgggaagatcacttgagcctgcaaggtcgacgctgcagtgagccatgattgcaccactccagcctgggagacagagcaaggccttgcttcaaaaaataaaaataaaagatgacattaagaagaaatctgatctcattgtctttattatcaagtgattgaaggctataatcattatttaataatcttgtagataatgattgtacttgaaagtgggc

SEQ ID NO: 5805 - DNA, 1705 bp, Homo sapiens
tggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcaggtaggtgagatgaaagtgattttatgggtagctttcagaaaaatgtactgcactgaagtgacaaagttctgtcttgcctgttctctcacaaaacagcatatcaattaaataatgttttctttacaatacagtttcataggactttccatttgtttcagagtgccttaactttttaaaaaaagacactgttaacaaatacaattatttctcttaaaatccactcagccagcatttttcactatcctataaaggctttaaatgtcacagaatgtatgataatttgctcctaacctacttttgaaaaaggaaagattccaaacattcttgaaaaaatggtaattcagaaaacacaaaaaccaattatttaaaataatccccaagcaaaaaaacctcagtgcaagaatactgcatacactttgcagtacacgaaatatcacaaacaatgcttttatcaatgtgctaacagtggatgttgttgatcctttcagttcagtagcataaaacaaatatacaaaaaatatgtaatagtcctctaaaaacattcatgctatactctcaaaagttgtgcaaaaataaaaatacagcagtggcaaagtatataccaaatacagacactatacagacagtgtgtaagaaactaggcatattgcagaacacaccatctctgtaaacttcaactctgcatgaaataggccactcagttccgcttggcctggccgctttccccattaatcagcatcttctcctgctgttctgcaagggcctgccatttctgcctgttctttctgcagccatctagcaaagggaaacagtcctctgacacgtgggtcagggcctaaagagaaaaaagaaagcaaacagctagagagaagccaggaaataagtcctctcccacaggcctgttacaaagggccacatcccacactcatttcataagcagactcactgttgaaattttcacaagctttgtgagcacatacacagatcatttacacatgattcttctaaaacactacagataaggagtacatgctgagggacagagcaaacacacacattccaaaataacattactgtgctagggagacagatctgtgtggaatccacttttaggggaaa

SEQ ID NO: 5806 - DNA, 537 bp, Homo sapiens
gactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactcctgaggagacggtgaccagggttccctggccccagtagtcaaagtagactcacctcccctcactgtgcctctcgcacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctggg

SEQ ID NO: 5807 - DNA, 2231 bp, Homo sapiens
aagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtaagtaattgtgggctaatcgttccaaatactgtttaagtagcttgaaaacaggtacatagaagtggaacaataagccgttagcttcagcagaagacgaacatgaaaaatgactgtaagctattgaaatttaagttaaatcttttatttttcaacaaaagaaatgtattaaataaaaaggagtaatcttgatcatttgctcaaactaccaataattttcactgtctaaagaaaacagacacatatttaattagattgaaggaaatcaaatgattaaaaaataggcctggcccggtggctcacgcctgtaatcccagcagtttgggaggccgaggtgggcagatacttgaggtcaggagtttgagaccagcctgggcaacatgggggaaccctatctctacaaaaaatacaaaaattaagcaggtgtggtggcacgcgcctgtaatcccagctacttgggagactgaggcaggagaattgcttgaacttgggaggcggaggctgcagcgagccgagattgcgccactgcgctccatcctgggccacagagacagactccatctcacccaaaaataacgattaaaaaaaaatgttactgggtggttttatttaaataaattttgtgtatatttcaggtatacaacatgatgttttgggatgcatatagatagtaaaaaggtttctacagtgaagtaaattaacatccattgtctcacatagctattttgtttttgtggcaacagctaaaatctcatttagcatggatcctgtttacagtataattttattacctatagttgtcatgttgtacattagatcgttagacttgttcagcctacgtacctgttcctttatattctctgacctatatctcttcctttactaactcccacatcactgttttgttctctaactctgtatatttgattttttaaaaaaatttcacatgtaaatgagattgtgcaatgtttttctttcagtcctcctgactcatctatgctgtgacaaatggcaaaatattttgtttttttttttttttgagacagtcttgctgtcttagcacttgctctgtcactgcactcaggctggagtgcagtggtgctatctcagctcactgcaacctctgcctccctaattcaagcgattcttttgcctctgcctcccaagtagccaggattacaggtgtgcgccaccacgcctggttaatttttatatttttttagtagagacaggatttcaccattttggccaggctggtctcaaactcttgacttaatcccaaagtgctgggattacaggcatatgccactgcgcctggccaagatctcattcttttttagggctgagtaacatatgccatcatatatatgcactgtagtttctacagtttatccattcatccattgatgatggacagttaggttttttctgtatcttggctattgtgaataatgttccactgaacataggagtgcagacatctttatgaagtgatttcatgttttttggttatatgcccagaagagggagtgctgggttatgtggtggttccatttttaatttctttagaaacctcccagctgggcgcggtggctcatgcctgtaatcctggctactcaggaggctgtggcaggagtatcgcttgaacctgggaggcggaggttgccatgagccaagatcgcgccactgcactccagcctgggctacagagtgagattccgtctcaaaaaaaaatttccatactgtttttccatagtggctgttctgatctacactcccgcgaacagttaataataattcattcttctcttaaacgaggcaaattttggaatatatttatttaattttttttttgagacagaagttttgctcttgtcgcccaggctggagtgcaatggc

SEQ ID NO: 5808 - DNA, 2202 bp, Homo sapiens
ggcgccccatgctggcagtggtaatgccgccggctggcatccggttggctgcgcgctgggaacgccagcgaggcagcgccaccggcttgaggagggtgaaagttcaattcttggcccctgaagttagcggaagggaacgggcatgttttggaaaggcccgccgggaattccctcagaaaccaggcgaagctccctgctgggccaggcccccctcgtgtgcttgaggaggatgggagcccggcctcggtttgttatcctaattaagtggaaaattaagaaaataatagaatagcgtaagtactaatagtaaaattatagtaagagaaataacaatagctagaatggaatgaattgctgtattaaccaaggctagaaagaatttcagccctccgaaagttaaagcgagggaagagagagaccctctcatattgttttatactcagtacctgtttttttttttttttttaaaaaaaaaaggaagtgaaatcaaagacaggcagcccagcgccaggcccaaaactggacctgggcctgcctggcctaaacctagtagttaaaaatcaactcatgacttagaaaccgatgttattcatagattccagacattctatagaagaacattgtgaaactccctgccctgttctgtttctccctgaccatcggtgcatgcagcccctgtcacgtaccccttgcttgctcaaatcaatcacgaccctttcatgtgaaattttagtgttgtgagctcttaaaagcgacagaaattgtgcactcggggagctcggattttaaggcagtagcttgccaatgctcccagctgaataaagccctttcttctacagctccgtgtctgagaggttttgtctgtggcttgtcctgctacagtccttggttccctgaccaggaagcgaggtgactgacaagccctgtggagcgtccctgcagaggactccggccagcctgactgacgcaatccaaagagcgctcccgggtaggaaatggccccggtggaatgccttgccagagcagcgcatagcaggctcccgagaaggattaacactggctgaacaccgggaaggaactggcacttgaagtccagacatctgaagcttgtcaagactagtttttggaacttgccccactccatgtgagtggaagcatggcctgatcacccacggtgtgcctgtattgacatctttgttctggttttgacttggcttgacttggtaagactagtctttggaacttgccccactccacgtgagtggaagcgtggcctgatcacccacggtgtgcctgtattggcacttttgttctggttttgacttggcttgacttggtaagactagtctttggaacttgccccactccatctgagtggaaacgtggcctgatcacccacagcatgcctgcatgggcactcttgttctggttttgacttgacttgaattgctggatactttggttttggttttgacttggcttgaattttttggtactcggattttgaatttcgtgattttggtttggtataaacggtaaaagtgtgtgtgccctctttacctgttctttgtcttgtggtatgtgtggtgtgagcgtggtattttgtctggaaaaaaaaaaaaaaaaacatgggtcaggtgcaaagtaagcccaccccactgggacctatgttaaaaaaattttttttcaagagagaatttaaaggagattacggtgttagtatgacaccaggaaaacttagaactttgtgtgaaatagactggctagcattagaggtaggttggccaccagaaggaagcctggacaggtcccttgtttcaaaggtatggcacaaggtaacctgtaagccaaagcacccagaccggtttctgtacatagacagttacagctggttttagaccccctttcccccaccacagtagttaagagaacagcagcataagcggctggcagagccaaggaacgaccagaaaagagaaaaagaggccatctgtaccaattctaagagtttagactaaacaagttcttattaatagcaaaggataattgaaatctcaaacttacaaggttttcaacaaaagtgaagtttgctaaaagttaacagtgtaacatgtattttggtaacttctaatcttgtggccttagacagtctagtccaaagacataaagaaagttcgcttttttaaaaaggaaagaaaaggg

SEQ ID NO: 5809 - DNA, 611 bp, Homo sapiens
gtcgttaggtgacatgtgcactttaaatgctctcatcggttggcttcattttcaagacaatcaaatgtattgactgtgttttcttcttagaaaatggagagggttaaaaacatgcaaactgccactttcaacctttgccagtattccctctacccccgtgagagctatctggggggaagaatccttaccaaggtttttttggaaagggttaaaggcgtgcaaccccccactggctgtgtcccctgccaccgaagtgagtgacctgccctacaaccaggtgggaccacctgtgctgcagtccggaggggcttctgcaggaagcactcaccccccacaccttccccggcctgagcttcccctacctttcgtcaccacctgagggcatgagcacaggccatggggcgtgcctggtgagtctgcctgtggttcaggcttagcctgtggtctcctgtgtgctgctgcccgcatgggatgcgcaggggaggcgtggggatccgcaggagggtggttgggatacaccggatacctctgctctcattgcttgtttgcaaatgctctatggacatttgtgtgctaaatcctattaaataaaaaagacgggttaaaaccca

SEQ ID NO: 5810 - DNA, 265 bp, Homo sapiens
gcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagatgaacagagtttatgaaggagcatcattctaagaattaagtgatgtagtctttatgtttggacagttcaccagattctcaagaaggctttcaaacaactat

SEQ ID NO: 5811 - DNA, 9428 bp, Homo sapiens
gcagagccgcggccggctggagggtgggcggtgccggtgaggccggcaggacctgagcgggtttgggagtccgctaggcgctgcccccactagagtcggactcgcagtgcaccccccgggagggaggcaggtagccctacagccggaggacagcagagatgcccgacagcaggccgagctggtcgggggctgcgagatagcgccggctggaaggcccgcaggagtcagaggtgatgagccgggcaggtgggtggaaagccggcggcggtcagagaatggatgccaagcgagactgccaatgactcaggacgtcccagtggagtcacagcgtgagcccagcaccgaggttttcagagtcagatgactgcagagaagatgctgatggcactactggccaaaacgggcttcactggagctgggatggagtcttgctctgtcgcccaggctggagtgcagtggcacaatctcggctcactgcaacctccgcctcccaggttcaagagattctcctgtctcagcctcctgagtagcttggattacaggcatgtgccaccactcccagctaattttgtatttttagtagagacggggtttcgccatgttggccaggctggtctcaaactcctgacctgaagcaatccgcctgcctcagcctcccaaagctctgggattacaggcgtgagccaccatgcctggctgttgtactttcagagcccaaggtaagcagcaggaaaagcccagggggctccaaaccatagtccagaggttgtgggacatggcccccacatccctagggtgggtacccagagccagctgagttcttcctcagccctttgctcagggcccccgatgtgctggaataagggtaacagattcctcagtctaatggcctggctcatcttgccaggccctgcctcctgctcagctgccttgagtccttactgggacatgctgctttttccacccagggcctcccctacagaaaccccctaatccactgttctcttcagggtttgaatcaggctacacagagataggccgttcatgtgtgggcgagggtccctaatcatccccaggagccagcaccagaccaggctctgccagccttcacatggctctgaagtgctgttaggtgataacgtacagtgaggggtgtgtgggcagaggagggttttattctggacatgggtggctgggtggtcagtcccccagcaagatagaggcctcacgcacatgctgccggaccactcgatctaagagggtgtgcacatctcgggcagcctgggcagcagcctccaacacccgctccaggtggtcctcgtgcagccgggcatccatctcaagcagcgcaatctgtcctgaggctggcagcagggccagggccagctgggggccaccagctgcttcctccacatggctgaggtccgccagggctgtgccgtccacgaagccagctgagcacgcacacacaaagtctctcatgggtatcccggcatccagcactgccagcgtggctgcattcacacaagctgcataggtcccaccatctgcctgtagcacctgcagggaacccagggtgtcagtctatcagactccctccccaaccccatcacacccttccctccctggattgacggctgcagctggctcacctgcacatagatatcaatctgggagcgtgggtgcagctgtgtgaggatggctgcttcgaaagtctggcggagctgcaggcccatctcacaggacttacggtccccatgtggccgtcgcttgcgctcacctgtgctgaaggtcgctgaactatattgacagttcactagggccctgtccggcagggctcgagcccgggagccccggatctggaagaggacagacacatgagccaggcccactccttccagctcacactccactgtcctctgtgggtctgcctctccctccactttcaatgcctcagcaaggggcaactgcgttacctccaaaacaaagccccctgttttgcgctctctgtcttgcatgtgtcgccctctggcaccttttaattggcttccttgtgtccatccttgccccattccctgccaacccaagtttacaaacatcaacgctgcttctgtctcacctacacactcaaatcctaactaccttacaaaggtttcacattacatatgaaataagatcccaaatcatttccctactctacaaaaccctaagtcctcacctccccgggaaccctcaacctgatttggagttatcccctctttccccaccagcagtctttctgctctgcataagtgccttgcttgttttcaccaccgtggtcttcgcccttctggttccctccgcctggaaagcagagctcccacactcatgcgctaagcaaacactctttcaataccttcgctggccaggcagttacagcgctggaagcacagtaatgaaaccagatagttttatgtaaagttcctttctttaggaagcttatgttccagcgaggaaacaaaggggaaaatgcttaagcaaaataggcatttgagattgtaggtgcacaaaacaaagggtttattgtagggcgagaagtaccgcgtggataataaggtcgtctgggaaggagtgacgtcggagtagagctgaaaggagagggagcgagtgggggagtgcctagcacgttgaagagccgcaaagaggaaggagggcgcagggacagaggccgatgagaaaggcaggaccaccgcgcagcacactaaggacttgcgtttactccgagtgagatgcggtgctgagcatcggctgtgtagactgaggcgcgccggccgttgcccctcaagtccccgagccagcgctcagcccggctgccccgcagctcccacggccacacgattccccatcccgcgcgcccactcgcctcgtgcgggccgtagaccacagccagtgccttggtgttgccctgctcaatgtaggccgagccgtcagcctgcgcgaacacgcccatccgcgcctggatcttgcgcagctccccggcgcgccgcccgtccacccggtagccctggtccgacaagagctccagccccgccatgctgcccggccgccaggtccgctctctgcctacttctctgagccgcgggagaactacagctcccggcggctccgaccgcccggaatctacggtttccggaggtccgccatcacttccggttccggggaactacagctctccgcggccctgacctccgtggatctgcggtttccggcgttccgctgtcacttcctgtcctggtgaactggagttcaccgcggccccgacctccccggatctacggtttccggcggtccggctctacttctgtctccggggaactgcggcggcgctatcggggaagcagcggctgggcccgcagccgttcccggagctgtgccacgggtgccaggaggtgggcgcccgccgaaggaggaattgcccagtcacgccctcgtgaccagtggtgcctgcattcagcccttccccgcgccccaagtgtgaaagtggaaggatgaacccagtggggtgcgacactgacaggagaaggcattgagcggtcctaggaaagtgaccaggctggtgtcccaggatggtccacacctggcacctctccagtcctctcatgccctccctttacaccgagcttccacactgcagtcaggtgggcctcccttttccctttgaggatgcagatttcctcatcctttccagagaggggttgtatgtctgtttatctcttgccacttaacctcagcggcttcaaataataaaaatcattctattattatgtgctgcaatctggggttatctaggctcagctagatagtttgcacttaggatctctcctacagttgctgccagatggtagctggggctgcagccatcctaaagctttctccctcacatctttggtggctgatgctggtggcgggccaggacctcatctgtgcctgtcaggcagcacacctacatgtggcttctccatgcaaccagggcttccttgcagtatggcaactgggttccaagggtagccttccaggacaacaaggtggacaacatgtgcatggtatttttaggacctaacctcagaagtcacatagtgtccctcctgccacactctgtgggtcaaggcagtcagacagatctgcccaggcttaagggatgaggacagggaccccacccttcagtgggaggagtgtcaatattagactgtaggaagagcaggcgggctagggaaatgtggtctgctgcaggggcccaagttcagttgtcacagcatcccctccaaggtggttaagctctcctgaaagactgaggcatgagagtgagtgagcaagccacaaccctgctgctgcagctggtctgaggccatgatgggtcaccaccctctgccacttgccaccccggattccccaccctctgctctacagccactctgcttattgtggagcccttttcccctttcagtctgagctcttactgtccctgttcttactgagtcatcgtttttttcgtttgtttctttgttttgttttgttttttgagatggagtcttactctgcacccaggctagagtgccgtggcacaatgtcagcgcactgcaccctccacctccagggttcaagtgattcttctatctcagcctcccaagtagctgggaaggtgggattacaggcacctgccactatgcctggctaaggttttttttttttttttggagatggagtctcactgtcacccaggctggagtgcagtggcacaatctcagctcactgcaacctccacctcctgggttcaaacgattctcctacctcagcctcccaggtagctgggattacaggcatgcaccaccatgccctgctaactttttttttgtagttttagtagagatggggtttcaccatgttgaccaggctgatcttgaactcctgacctcaggtgatccacctgcctcggcctcccgccaccacgcatggccattactgggttgtccactgacagtccttgccgcatgcgggaagactagacgcccagggagctctgtggactgcccaccccagttgtgtagcattgaccgtagcaactcaggacaatgaggacgatgttggtcttcagcctaaggtgtccaaagtgggccagtgatagccgctacttcaagatcagtggaacctttgctgtgttccctggtggaagtattcatcttcaggaaccaggcctccaacctggcagcattacaggtttaggattatggggccactcctacctcacacctttggttctctgaccctcgtactccagctttagggtacacacatgggtcgattcaaattttggaggcctaaagcttatacaaattcaggggccgtgagaggtatccccaagacccctccagagtaaccgatttgctagaaggactcactatagacttgtcttcacgcctaagattattacacagagaggatataagtctgaatcagcaaagagaaaaggtgcatgggatgaattccacaggaaatcaggcgtgagctggccacgtcctctcctggtggactccacgggaagaagctggagccgtgtgtgtgaaatgctgtctgccagggaagcttcttagacactcagcgccctggggttttatggagggctggtcacatacacagtctgtgccaagcatgtgcccaaattccagacccctagaagcaacacaggtgttcagcatgagccatatttgtacaaacagtctaggcacagtgagacacgcttaccagagagtgggggaaccatgaaaaacccaagttcccagacacccactcttcaaacttgcctgtgaagaagagcttctcaggcctgctgttaactcttctatgcagtcttcttttgaaacataagacaaaattgtatatccaaaactaagtgaatagtgagaaaagaagtcccaacacataacaaacattttaaaagttgtcaaatactacaaacatcacaaaatgcagaaaacctgcctgacatatttgactccaacaggtttcccctacatttctttgatgcgttctctgatgctctcttaagatgacaacacctttttataacgtaaccttctatatgtagaaagaatatggcagacgcggtgctcgcgcttgtaatcccagcacttttgggaggcagaggcaggcggatcacttgagcctaggagttcaagatcagcttggacaacatggcaaaaccccatctctacaaaaaatgcaaaaaatcagctggacatgggccgggcgcggtggctcacgcctgtaatcccagcactttgggaggccgaggcgggcagatcacgaggtcaggagatcgagaccatcctggccaacacggtgaaaccctgactctactaaaaatatcaaaaattagccgggcgtggtggcgggcacctgtagtcccagctactcgggaggctgaggcaggagaatggcgtgaacccaggaggcggaggttgcagtgagccgaaatcgcaccactgcactccagcctgggcgacagagcgagactctgtctcaaaaaaaaaaaaaaattaactggacatggtggtgcatacctgtggtcccagctacttgggaggtggaggtgggaggctcacttgagcccaggaggtcaaggctgcagtaagctgtggtcacaccactgcactccagcctgggcaacagaatgagaccctgtcaaaacaaaaaacaaataaacaaaaaccaagaaaatgatttagtttctcctctcacatgtttgatcaaaatttaattttattactaataattaagttgctttcaggtaaaagctcctttgggtaatatgtacatttttagaattgtcattaaattggaggaaaccgcttatcaaatttcttccacatatgagccataacagttcagggcttggctgggtgaggtagctcgtgcctgtaatccaacactttgggaagctgaggcaggaggatcgcttgaggccaggtgtccgagaccagcctgggcaacatagtgacacactatctctacaaaaaaaaatttaaaaattaactgggtatggtggcacacgcctgtagttccagctacttgagagactgagacgggagggtggcctgagccgagggagttggaggatgctgtgagctatgatcgtgccacggtactcctgcccataccacagagccaggctgtctcaaaaaaacaaaccaaaaaacccagaaccaccccccgccccaaaaaaatgaatttgagtttgggttttcttgtttgtgactaatcttagatcctctttgagttggcacttggccaatttcatcagcttgttgtgtcatgacatgcagccgagggaggtgggtgtttccggaagccatttctacaccagaatgactagcgatagcataactgtatcgggaagtgactgttcccgctaagcccaagcaaaacgtagcttcaactcaacctcccgggagctggaccccacaacaccccctccagctctatgcagcaggggagggggtaactgatgggggtaactgatggcaggttgcagggggaagagacagttttagctggttgtgtttaaaatatttcacttttgcaaattttacgaaatatatgactctgtaaatactttgttggggcccaagccgggaaggggctgtgggactgaggatcctggaactgatccccgagattcctggtgagcctgtttctcgagcgccaactccttacagcagcacaggccgtatcccagcagaagtgcccctccctggaaggggctgacatccagcaggcagtggggcagggccttcagcagactgtgccactattccgttgggctgacaagggtttgggagacagtgagtcccaggaacatgagctcattgccacacagtaggctctaaggtgggttgttaggattttttttttttttgagacagagtctcgctctgtcacccaggctagagtgcaatggcatgatcttggctcactgcaacctctgcctcccgtgttcaagcgattctcatgtctcagcctcctaagtagctgggattacaggcgtgtgccaccatgtctggctaatttttgtatttttagtagagatggggttttaccatgttggccagtctggcctcaaactcctgacctagtgatctgcctgctttggcctcccaaagtggtgggattacaggtgtgagccaccacacccggccggtcgttagtatttatcatggtccagtggaaggtaagacattccgaaagcttgggatagaggtgctggtggaggagctgttggcaggaagagcaaagttgcgttcagagtaggtgtcggttctgggaagaacgaatcgctgctcctccaggtgggaggggcctgaggtctttgttattgttttttgagaaggaatctcattctgtcgcccaggctggagtgcagtggtgcgatcttgactcactgcaatcttcgcctcctgggttcaggcgagtctcctgcctcagcttcccaagtagctaggattacaggcgcccgccaccacgcctggctaatttttgtatttgtatttttagtagagatggggtttcaccatgtaggccaagctggtctcctgacctcaggtgatccgcccaccttggcctcccaaagtgctgggatgacaggcgtgagccaccacgctggccacacttgaggtctttggtctctgctgctatgggctggacattcagcagtcagtaggaccatacagagccactgtccctgccaccatggccactctgttcatgggcctttgcataagctaagctttgacatctttgcctgcaaagcccagagtctgggccccttcaaaggcacttactgttgcctgctcttcatcctgtgtgacagtcataccatcctgaagtcaacatatcaaagggacacctgcacccccttgtttattgcagcaccgttcacagtaggcaagatatggattcatcccacgtgtccatcggtggatgaatgggtaaagaaaatgtgtgtatacacaatagaatacctttcagccacaaaaagaatgaaatcctgtcatttgcatcaccctggaggttattatgttaagtgaaataagccaggcacagaaagacacacatggaatgctctcactcacatgtgggagctaaaaaagttgatcttgcggaggtagacaatagaatcatggtccccagagactgggaatggtgcgtgtgtatgttgcggggtggtggtaaagagagtttggttaatgggtaggtaaacatacaggtagataggaggtataaattgtaggtcgggcgcggtggctcacacctgtaatccaagcactttgggaggctgagacgggcagatcatttgaggtcaggcattcaagaccagcctggccaccatggtgaaa

SEQ ID NO: 5812 - DNA, 697 bp, Homo sapiens
gtcccatttattagcaaaattactttattctaacaaatagtttaacacaaaaatacgaactagccctccagggatctttggggtctacgcttcccatcgcctcagtgtccggtgcatgaggaaggtgtcctctgaagggcggggccggagttgaagtcggagagggggcagaccgtccagggtcaggtgtggagattcataaaatagcgtttctgggtcacacaagatggtcatgtctggcccaggcccaggtggctctttgggtgcggggctcgagcctgtggcggcaggagagccaatttctccctgagcgcggcattcagaacctgttcctccggcacctgcaggctcaccaggtcccggaagagccgcttggagcgcggcacgttcagccctgagagcgcagcggggacggaggtgagtggcgcgcctcaccccgactcccgcacgcggccggccgcccgcccccctcaccctcggacacgctctcctccaggccgcagcggatctggaacgactttctcagctgttcctccacggccttcgcagcatcaaagtggctcccggctgcggcccgcagctccaggcccaaggccaggctgctcttcagcacgggcatctccagctcctgcggcaccgcaggctgcggctcggaccgcaccggggagggcggcgtcaggcggaagcggacctggga

SEQ ID NO: 5813 - DNA, 12053 bp, Homo sapiens
atccgggcttccgcgtagtccgggcgccctggcctctgcaccgtcctagaaacctgtcttacgtcgaggaacccgggggacagaggcgcgccagtgcacgccggggccagggacgaacggctcgccaatgcaaaggaggcccctcggggagacggcaggcagcaaaaggcttccttggccgggggtctgggcgtttggggaggggaggtgctcagagatagggccgaggatggagctcccaggtgggttggaggcgggggtggctgggctcgaggacgctgttggagtccggggtctggaagaggcgatccccgggaaagccagcttcagagccgggaagggtcggcaggggacctactgcaagagcccccaggttggggtagggagggggcccagacctgggccgggagggatgctgaatcccccgacctagctctggggctttgcaaaccagcatcactgcagcattttgtggctcaaggaatggggcagggcggccagaccagctgtggctggtgcgtgcgtgaggccctgagggatgcggccaatgctattttgctgttttgtacttactcagtttcattttggctctgtcgccactaggcgaaagaaatcgaagtgctaacataccacggggagcaatgattattactcaatgtggccccgccccagcagcgggaggtggcatctgtttgaccttggagacttggacggtatttagggagattacatgaaaaaaagactcaccccacaatgcttgcagtcagctacaagctgccttgtccttcataccttttagcctttatttcctgagtctatcttgtctgtttctaatgtagtctcctgatttagggcaagagaatatttctcactcttggtctgcccactacccacaatccttgtccgaggatttactcggcaaacttagcaggcaaaaccccttgtcaacttaacactaaaaaataccgtctcttggaaggcagtctgctttgataaacctaatggaataaaaagtgagtttgctatctggctttaaagaacataacccagctgggcatggtggctcacacctgtaatcccaacactttgggagaccgaggcaggaggatcgcttaagcccaggcgttcaagaccagcctgggcaacatagtatagtaaaacccagtctctacaaaaagaatttaaaaattagccaggccagatagcccagctacttgggacgctgaaacaggattgctttgagtccagcaggtggaggctgcagtgagctatgactgcaccactgcactccagcctggtcaacagagcgagatcctgtctcaaaacaaaacaaaaaaactgacaaccaatgaaacctcatctctaaaatctggcttcaggttaagtgagtaaaaagaggctttcttgtggccaggcacggtggcttatgcctggtaatcccagcactttgggaggccaaggcgggcggatcacgaggtcaggagttcaagaccagcctggccaacatagtgaaaccctgtttctactaaaaatacaaaaaaattagccaggcatggtggtggatgcctgtaatcccagctactcgggaggctgaggcaggagaatcaacgtgaacccaggaggcggaggttgcagtgagctggtatcacgccattgcactccaaccccgggcaatagtgcgagactccgtctcaaaaaaaaaaaaggctttcatttatcttctcagctcctacaagccaatgagtggtagggtaatttgccgaccacagtgggaagaactaatttaacaccaagattgtgattcccctagtgtagatccagtatgaaagaagtgtctcaggcatgcttctggttcctgagttaactctagtgaataaggtgggctgtgctgtctccccacctcccccaggcataggggcagaacagctgcagaccaccaggacccagtgggccaagtgaggatgtgagtcaaagccagtgcttattaaaccacctaatactgtacttttcccatccaggggaggcaggagaggattgaggaggcaaatccccgagcccagaagactccagtcagaaaacaagatggtccccatgggtagtggccaatccctctggcctttcagagcagtggctttggccttgtccgcttaggtaacaggctctgctgctggtagttgcttaagagcacagagtagccgggcgtggtggctcacgcctgtaatcccagcactttgggaggccgaggtgggtggatcacaaggtcaggagatcgagaccatcctggctaacatggtgcaatcccgtctctactaaaaatacaaaaaattagccgagcgtggtggtgggtgcctgtagtcccagctacttgggaggctgaggcaggagaatggtgtgaacccaggaggcggagcttgccgagagccaagatcgcaccactgcactccagcctgggtgacacagcgagactccatctcaaaaaaaaaacaaaaaaaaaaaaacacagagtgaaccagtgagaaggttaaatggaggagaaagcaaagttcttaagacaaaaaaagtaccccaacaagggcaggaaacaagctaaatgacataggcacagacaactggacaaacccagaacgtggggccttgagactgtcaagtagcctggtctcaagccattatcaggcccaggcgtggtggctcatgcccattaattctaacactttgggaggccaaggtgagaggatcacttgaggccagaaattcaggaacagcctagacaacatacccatctttacaaaaaataaaaatagatttattggaaggccatgttgaaaaaaaaaaaagaaaaaaattagccggaagtggtagtgcagccctgtggtcccagctactcgggagactgagttgggaggactgtttgagtccatgagttggaggctgcagtgagctctgattgtccaaagcactccaaccagggcaactgagaccctgtctcttaaaaaaaaaaaaaaataggcaaagaaatctaatattgaaatgcaattaatgaattttaattggagtctaggtggtgcgggagggggattggaaaaagctatcaaatgcattctgaggacaatttggagaaatttgcatatgggctgatattagggaattattaattgggtgataacagtatggcggttatattagagaatgtccttttttttttttttttttgagacagggtctcacggttgcccaggttggagtgcagtggcgtgatgtcagctcactgcaacctctgcctcctgggtttaagcaattcttgtgtctcagcttcccaagtagctgggactacaggcacgagccaccacacccagttaatttttttgtatttttagcagagacagggtttcgccatgttggccaggctggtctcgaactgctgacctcaggtgatccgcccgcctcggcctcccaaagtggtgggattacaggcgtgagccactgcgcctggccgagaatgtcctttttgtaaggagaaatatgaacattgggagtaaaatgccaacagtgactttcaaggttccacaacccatagaggaatttatctgccatatcaaggagtgggtctgtagccaatcactgtaacgttcttttcaatttttgtgtttgggattcaagtgccccaataccacctaactaccctttaaatggaattaaatattctaattcaagatatctgttttgggaccaccaaatttcaactatctatatttaaaatcacaaggccagagtcacatcagtgctcaaaggcagcaaaaatcctatttcaagctcaaccaaattagaagaatggatggcagtagttacctctaagaatggcaattaatgggtgatcaggtaatgggcatgctgggaagagtttctgataaaccaggggtctgcaaactactggccagagggtaaatatgtcaagcattgtgggctgtatacggccgcctcacacttttgtaacgtgtgtgcactgccaattcaaaaaataaaaaccagctgggcacagtggctcatgtctgtaatcccagcactttgggaggctgagatgggaggattgcctgaggccaggagttcaagaccagcctgggcagtatagcaagacctcaattctacaaacaatccaaaaattagccaggtgtgtgtggtggtggtacgcacctatggtcccggcgactcagaaggctgagataggaggatcatttgagcccaggaggtagaagctgcagtgagttgtgatcatgccactgcattccagcctgtgcaagagtgagattctgtctttccaaaaaaaaaaaaaaaaggccccaagtcatagtgttcctcaaattcctacggcctttcctctccaatactctggataacaggataacagagtgccacgtgagtcccttacataacctgagatgtcttgactcattgtcttgccagtgtgatccagctactctcaccctaactcctcactgaccacagcgctgtgtggttaatgagaggtacagcttgtggccattcagattcaaccacgtttatccacatcagagttggaaaattcaaaccagtgggctaattagcaagctggtatgccacatgttaatgttctgattaggctggtgaccactgattgtcaactcctagaacagggttacccagctagtgctcagaaggttgtttctctgagtaggctttgggaactgtgcacccaggagggaggtgccattcttagccactcaaatcacccagtgaatcaacatgcagtttcagctgaccagagcagaggccaacgcatgtggtcatcacacataaatagagtggaggaaaactgctttcatgctttgctgtactagaaggtcccactgaattacatttatggcctctccactctacccctgacctgaagttcttggaatggagacctctgatgtttcacactgttatttttaatcacctttcggacaaagtatcagtttttgtttgtttttgagatggagtcttgctctgttgcccaggctggagtgcagtggcaggatcttggttcactacaatctatcttctggttcaagcgattctcctgcctcagcctcccaagtagctgggataaaaggcgcgtgctatcatgcccggctaatttttgcatttttagtagagacagggtttcaccatgttagccaggctgatcttgaactactggcctcaggtgatccgcctgcctcggtgtcccaaaatgctgggattacaggtatgaaccaccacacctggcctagtatcggttatttttaaaattctagaatgcactaaaaaagaggcaaaaaagacctttaccactggtgcctgatctacagactgatttaattcatgtagtatgaggtcttttttgtttattgtatttgagacaaggtcttgctctgtctcccaggctggaattcagtggcgtgatcatagctcactacagcctcaacctcttgggctcaagcaatccttccacctcagcctcctgagtagctgaaactacaggtgcacaccaccatgcccacttaatttttgtagagacagaggtctcactatgtactatgttgcctaggctggtcttgaactcctgggctcaagcaatccacccagctcagcctcccaaagttgacaggcgtgagccaccgcacccacctaatgagaactttcttaaccttattctgcttctgccattcaacttcaattctttaggttcacccctttccaactacttatttgtgtgatactgtatttttttcaaatacttcaagtgaaacaacatatcacaataggccaggtgcagtggctcatatctgtactcctagtgctctgggaggctgaggcagatcacttgaggccaggagtttgagatcagcctggacaacatagtaagaccctgtctctaaaaaataaaatggcccagctggacgcagtggctcacgcctgtaatcccagcactttgggaggccgaggcaggtggattgcctgagttctggagttcaagaccagcctgggcaacacggagaaaccccgtctctactaaaatacaaaaaaattagccaggcatggtggcatgcacctgtaatcccagctattcaggaggctgagacaggagaatcacttgcacctgggaggtggaggttgcagtgagccgagatcaagccactgcactccagcctgggcaacagagcgagactccatctcaaaaataattaagtaaaatggcccggtatggtagcactcccagctacctgggaggctgaggcgggaacacgtgagcccaggagtttgaggctgcagtgagctatgatcgcactgctgcactctagcctgtgagacagagcgagaccctgtcttaagaaaacacatatcacaacagactggacgcctaagcagagagtacgtgtgacttagctcccaagagatctgcaaaacagtaaaacaaagctactcttgcacctgtaacgggacattacgccaaaggaacaagggtgaaatagcggcaactttcaggggatctaccttccttcttcagtgaccctgttagagcaagcttgactgttctgatcttgttcatatctgtgccaaaagtgttttttttttttttttgccctcagtaactgcaatactaaaagtgcttggtcagttaagtgcggtggcttggcctgtaatcccggcactttgggaggccaaggtgggcggatcacctgaggtcaggagttcgagaccaacctggccaacatggagaaaccccgtctctactaaaaatacaaaattagctgggagtgatggcgcgtgcctgtaatcccagctactcgggtggctaaggcaggaaatcgcttgaacccgggaggcggaggttggggtgagccaagatggcgccaccgcactccaccctgggcaacaagagcaaaactccgtctcaaaataaataaaataaaagtgcttggtcaatgtgtgctgaagagttggttgctgccgctcggcctagtttcttatggtctcctagcagtgcaaaagcagcctggtgtgggcagaccaaactcaggcaggcagatgcgggttatcagtgagttacagcaccttaggtatagcagtcactcctaattctacagccatacacttgcagtggcacccagggtagttctgggtgacaaatgagtcaacgtaagtgaattcactgagtatatgccaaaagcctattcacagtgtgttatcattcctgaaatgtgaattaatgtttctcagaaaattaagaagcttggccgggcgcggtggctcacacctgtaatcccagcactttgggaggccgaggcaggcggatcacttgaggtcaggagtttgagaccagcctggccaacacggcgaaacccggtctctattaaaaatataaaaattagctgggcatggtggtgggatcctgtaatcccagctactcagaagactgagacatgagaatagcttggaacctgggaggtggaggttacagtgagctgagatcgtgccactgcactccagcctgtcacaaaaaaataattaaaagctatgatccagttatcatttaaacctacaaccacacccacacccacccaggctaagaagtttgaataatttgcccaggaatcaaaaggggccataattctgggaggatcacttgagcccaggagttcgagcccagcctaggcaacatggccagaccccatctgttttttgttttgttttgttgtttaaaacgggcaggatggggcgtgccatcactcaaactcaggtctgtgtttctccccagtggtaccccggaaaggccctcagagatccagttgaacaggctcgtttaatatgagaaaaatggaggcccaaaaggtgcaatggtttggttttgttttttcaacagagatagggtctcaatatgttgcccaggctggtctcaaactcctggcctcaagtgatcttccggcctcagcctcccaaagtgctgggattacaggtgtgagccactgcgcccaccctaaaaggtgcaatttttttttttttttggagacggagtctcactctgttgcccaggctggaaggcagtggtgcaatcttggctcactgcaacctccacctcttgggctcaagtgattctcctgcctcagcctcccgagtagctggtcctacagacacccagcaccatgccctgctaatttttgtatttttagtagagatggggtttcaccatgttggccaagctggccttgaactcctgacctcaggtaatccgcccgcctcagcctcccaaagtgctgagattacaggcatgaaccactgcgcctggcctggtgcaatggtttttttaagtccccaaacccaaatctgattcctggttggaggcgctttccagtatctactgtctttcccctttttcctgccaatccaacttcattgcttgggctggggagggaagagaacaccaacatctgatccaaccttcaaaagcaaaggacagtaaaactcacacaatgaagctaaggagcactggcgtcagatctgtaagtttatttgctcaatgtacgacagctacataatgactcacattcatgatattccatcactgaggaaactgctaaagatggtccgtgtgtgaaataattccttagagaaacacggagctggaaaaataatcactgattagaccttaaaaatagttcactgcataacatgacaaaaagcacaaaggctcattcagagaacatatttgttgttctccaacactgtaatagttataatttcaccatgacaaacaccagacattaagattaagctaacactggtgtttcttttgctcccccccttttaaaaacaaaatatataactgcatgtcactatagcaacatccaaaacagatcaatttgttacaatcactatttggtagagcaaactttacccccaaaaggaaaaattaaattaaaaaaaaaaaacctttaaaaaatttgaagacttaattttttttgtcataggaatacataacacctacagtataagttaatcaatttcaagctactgtatagaaatacaacactagcatgcacaatattgtatcaatagagtaatggaggagtaatcatttcactggagagacagtatcataggcaagtgcatttctttaaaaataaagaaaagaaaaaccattcaagctgcttaaatatcaagtctcccattccctctccgttttcagccctcaggtgtgatttttatcttgcattattctaaaaagcagccagagccaaagctgaaatttaaaggaaaaataggttttgtaattccagtaaatcatttccaaatgctacaaggaaaaacgcaacactgctcactggacatgaagataaattagggaaagccccacctaccctgcccccccccccctccccccccaaatcgtcttcctcccatggcaatgactttaggcgcctgtgagaggcacaaaagcggcaaagcttcttctactagttcttctggtaggcttcacttaactgggacttttactctagcgtgaggagggggcctcctaaggaaagtcatgctgggtaaactgtgcgatgttacagagcacattgagtctgtggtcatcgtggttcttctatcttcactgtcacctgtatcctgttacacatactcagttcctaattgtaagctcaattttggtattagcaaaagcatctgtcagtttttcctcaattactcacacctcttcttgcctaaataaaacaaagaaacaaagaaaacaagtgtggtgtcattacacgtctcgggagttcctcgtcactgactttatatatataaaaaaaagaatgcacatgcgggccacgttcacagatagacagattcacccgaaatgagaatgagggccttaaggctgccgaaaacaaatgggtggaaatagcaacgttgtttccgtcaattccaaatgtgcactggctgcgtgagacaagccaatctccaattcctatgcttttttcattaaaaagaaaaaactatctcgagaggaaaaagttctggtcaaataggagttcagtgtttgttatctggtaacagtttttttatcttcctacaattacttggggaaggagtgtcttcggggaggaaaaactgacacactgacaaggctcccgaaattggacagaatggttaaggatatagctcttccttttgggtttttctaccagtaggcttctagcacctgaattttcacacactgcaccacagaccttctccaaacgcctctccgaccccacagcttctgcacccagctgcgtccgccagcacgaggcgcagtaggaaacgccccagtgcagagtgggtgacggcagtgtgatccctgaggagggagctgcagcagcttcagaagcgggatgttctctgaaaataccaacacgatccatgacatacagacctgaattttctctatttttgtggcgtttcacgtttctctcaagaggattaataattttggtggtggatttacgttaagaggaaagaaggaccaaaaaaaaaaaatcccacagccacctgacctgaagtcgctttcattctcatttagcctaggagaccgatcaacagcaaaaccaacctggataaggctgaataaggatgttaaagcccaaacaactagcaaaggaaaagtacacaatcgatggcttgatgttacatatggctgtaatgtagaaatactgtaaactgcaatttagtgttaatactgtcaactaatcagagacttcggaaaactggcaaggcctaaaccataaggatgaatgagacctcaggttctaagtctgtcagtctgggatttacactgttccatgtctgtaggctacaccctggaaaacatgcagagccgagacagatgagatagaaagtacccaaaacgagagacgagagcgtatgtacataaaaatccttactggaaccacagaacttactgaatgagggccattcctctttaagttttcttttcatctgaaaaccctattatctagcaataagttaaattagagacagacagctccacttgcatgaatctacagaacagtccagacgccagtgtgaggctgctattccaataccagcacagctagcctgactttccactagtggtattttggcaaaaatgtcaaagaggcgatcaaagacaggacaggtcgtgggtttctccctgggaaggtcatccctccctttccctcccccacccgacccccaactcatgggaaaaaaataaagactgcagtagtagcatccgcgtgcgctgccagttcccctggggccttaattgttgccttcgccgccatcgtcgtcctgctggtcgctcgtccagagcgtgaggttgtcgcggaggagctgcatgatgagcgtggagtccttgtaggagtcctcgttgagggtgtcaagctcggcgatggcgtcgtcgaacgcggtcttggccaagtggcacgcttgctctggggcgttctggatctcatagtagaagacggagtagttaagagccaggcctaatcggatggggtgggtgggctgcatgtgctctttgctgatctcgtgggcttcgctgtaggccttctcggaggactccaccaccgtcgcccttttctctccggtggccacttcagccaggtagcggtagtagtcccctttcatcttcaggtagaacactttgctctcgtactgggtctcgctgcaattcttgatcaggtagttatccagcaggctcagcacatcctggcacacagcctccaactccttctctatcttctcccggtacgcacggaccatctcaatcttcttctcattgccgtctgcagatgtcttctgctcaatgctactgatgaccctccaggaagagcggcgtgcccccacaacgttcttgtaggccacagacagaaggtttcgttcctcattcgacagtggctcattcagctctgtcacctgccaggaggaaagaacagagttgttatggtacagatggtgtccactgggttaactgtatctttgag

SEQ ID NO: 5814 - DNA, 2079 bp, Homo sapiens
ccggggctaccaacgggagatgcagtttatttacaccagcagccatgggggcagagggaatacacagcgtttacaaagttagctacctgtacagaatggattacatatgcaaaaataaaaatctcaagaccacaggacagcgtgagccccacccccctcccccaatgaccccagcatgcggtaatgccaggcgggtggcccctgggcatgcgggggggagtgatgcatggaaggaaaagccaccggccatggaaattagtacagaacccccccacacacactcagacacaggatacagggtggacgacacctagccggggtgggaaggatgggaattgaaacccacacagcctgctgttagagggaggggagtggggagctcctagcccctgttcaactacatggtagggggggcactctctccccagaaggaaaagggtttgttccctcagggtccctgctggaccaagcccatctcttacccagcctgggcagggggctctgccctgagggcgggccaaggaacaatggggaagtttatgtggacaaaccagttcccaagctacttcccacttctccctcctccaaccagaaggggggaaaagggagaggccacagggcaaagagtgtattagggcctgagctgcagctgcctctcagaagggagagtggcccacagccttcctcccttcaccttcagcccactccccagactgcatctggaagcggctagaggcctgctgagatcctcctctccctctggcctcctctcggagggagactacggagggccaagaatagagaagcccaggccccgggatttattctaactcctgccaaaatctgtttggctttttaaaaaataatcacaatttgtgggttaaaaaccaatttgcaaccaggcatgagccacaatcagaaccaccccagcgggagagcggagttccagacagggcattgcagccccatctctgttgttcccttaaccctctagggtccctaacccgatcagtccaaccagtcctgggtactaactacccaaatgtgggatggctcctcttgggaagagggtaggggacatgtccagcaagtgccagagaacttggctcagggtcacctccacccatgtcagtcagctctgctcccagcccaggtcgcggtcctccagcttggctcctgggagtggtggtgcccgcatggaggggggacggtacatctctttaggatgtagaccaggcaggtgggcacactggcatgacagtcccacagaggggcagtgacaccccttcccctccactgacaacctggggcacagaggccaccctctcttcccacccaactcctagcaaagggggagaggcacaagattaggattttcctcagagccccaaaccacaagtacagaataaataacttaaaagcgctaaggaagggaaacagggcacgctttggaggcaggagcgctgagaggaactgaagccagtcaaggtgaagggggtggaagcagcagttgggaacctgggctgccccggtagggcagtggggcagggtgggcaggaggaacacggggccaccccaggagggtgaggctgggtcccttcctggggcagggaatgaggtaagaaaacatttcaaataaagcagcaccgttccctctcaccttggggccccactcctcaccagccctgggtcagggaggagaggcagggggaggaattctgacacttctccctcttcctaccctccctttcccattccttgaagctgtagaggctggaggccctttcctggcacccaacaaaaggacagctcctgctgccaaggaggcccatggggactgaggggaaagggctgcccctgtgaggggcagggaaggtggcggcagttctggacgcccacctcagcagacagcactctgtgcctgcctacccctgggactgggggcatttgataagattctgcacacagacaggacatgcccagccttgcccctcagctccaagcaccggacccattcacattgctgagggcggccgaggcaggcagtgccctggcacagtgcccaggtcaggcccctgg

SEQ ID NO: 5815 - DNA, 1661 bp, Homo sapiens
cggcgaggctgaggaaggtccagcaagagcaagagtctgaggcggaggaggcaagcgccagtgcgggagccctgagggcagacagacccgaccaaggggcgtgaagggctcagccgcagacaggcccggcctgacagggccggcgggcagggcagaaggcaggcccgaggctgccacagcccacaggtgctgccatctctcctgggcacggcggtggcctcttggcagctagctggggcggcacaggcgccttggaccttgagtctctgatgagctggccccctccctcaggggcatcaggcccccagtgcaccttggggttcgtgcgccgagtgacctagcgccagagcttctgagcaacggtgccgagcggtgtcaggtctcggcccacagacgccagcggtcgccaggcggccgcagaggggcaggggatgagtcaggccttgggagctgggcctggcgggaagcagggtccatgcacggccgagcaggtggcggctcccaagggaggccagagggcggcgagctggcagagctatggccctgctctcctggcggcagccccacagcgaggcagaggcagaggggtggagggaagctggttacctttccaccatgcggtctcgctgccgctttttctgcttgtcctgactcttcttgcctgcctgcaacttgcgcttggtctggccattttcatcctgggtggttagggcccctgtgggagcagatgggcactgtcaccaatttggctctgccaggacagggcaggccctgcggcctctggctgaatcacccactgtccactccagagggtccatcgagaatagctgtccaagcaaggcctctggccatgagcagggctgggtatcctgggctgtgcagggagtgggtttggcctaggccccaaggagtgggggccaggcgatgacccctccactctccaggacacccatgctctctgtgcagtgggccaggaggaggctggaaagcaaagagggggtatctttgtggggacactggcacatgttcagaggggccaggtggtgggatgcagggaggctgctcacatggccctgcccacccccaaccgggcaccgcggcaacagtgggctgacgctggatttgctgttaggtacctgctggcgctcatcactcaggtggggggacacggaatcccaacaggggctggagaggtgctaagggagaggatacgcacaccagagccgtaaaaactgcaccgagggtcccagatcggacaccagccactgaggacttggaactgcgcgttactgagggaccgagggcagggggcgtgcctggggttccccacacttttactagctgcccccatctgaaggcaaaaccagtgtgctaggcaggggtcaccaccatccacagcctccgcctgggaaggaggaggaagagtgggaagggggtggaggcggcgaaaagaaagccccctgccagcacacactcgggcccacaagggaggtccccaactggccgcatgtctgccgcaaccctgccctcagctgggtccctcccactgtgagcccctggaagagccgccctagcaccaggcaccccaggaaaactcacccttctctggatcctctttgccttcttctctcccatcctcttttccctcctcatcctctccg

SEQ ID NO: 5816 - DNA, 1956 bp, Homo sapiens
tgtaaattaaacatgacaacatgcattattcctgtagttcaaatagtgacagaaaaaaattaattaaaaaaagaaaaaagactgggcgtggtggctcacacctgtaatcccagcactttgggaggccaaggcgggtggattacctgaggtcaggagttcgaaaccagcctgactaatacggtgaaaccccatctactaaaaatacaaaaattagccaggtggggtgatgctgtaatcccagctagtcaggaggctgaggcagaggttgtggtgaggggagatcatgccattgcactccagcctgggcaacaagagcaaaactccgtctcaaaaaaaaaaaaatcaattaaaaaaagaaaaaaatgcattcttatcagacttttatgtttctcatatatagcactgttttcgacagacttaaacatagttatttattatataccacttttttgcacaaatcaaaaggaaaattggctgggtgcagtggctcacacttgtaatcccatcattttgggaggctgaggtgggcggatcacgaggtcaggagtttgagaccagcctggccaacatggtgaaaccccatctctactaaaaatagaaaaaatagctgggcgtagtggtgggcacctgtaatcccagctactcgggagtctgaggcaggagagtcgcttgaacccgggaggcggaggttgcagtgagccaaggtcacaccattgcactccagcctgggcgacatggtgagactccatttcaaaaaaaaaaaaggaaaataagtgaaataaacaaaaaaatcagtttaactttttgccatatcagacatccttagaagaataaacattggccgggcgcggtggcttatgcctataatcccagcactttgggaggctaaagcaggctgatcacctgaggtcgggagtttgagaccagcctgaccaacatggagaaaccccatctctactaaaaatagaaaaaaaaaattagccaggcatggcggtgcatgcctgtagccccaccgacttggaggctgaggcaggagaatcacttgaatccggtaggcggaggttgcggtgagccgagatcgtgccattgcactccaacctgggcgacaagagtgaaactctgtctcaaaaaaaagaataaacattaggctctgttagtatgaaaaagccttgtttatgtatgatttttccagtgctgaaaatgggatggagatttagaagctttggagggaggtggttttatgtttttcatgtgtcctggattcctcttgtgtggccatagcagagggcagtgataggggcatcccttacaaatgcccttttactgtctggcttggttagagttctttggccaagttcctgcctctgttgttatggtcctcctaccagttcatttagggatcaagagttaatgagtctctcgggtcgtttttgtgaggtccagctttgtaaggagtccttccttccttacgtcttggcttaagacatgtcctgctgctgctaagttgtcacagtcccataggggggcaaaatgagaggagcttttaagacggacttcacgattgcagcattttaaatggctacatgttttatttccttagctttagtgtttctgtagagaaaagagatggatttcaatttttttgcatgtcactctgacaaagttctgtttcccttacagcagccaagaaactaaaataaggctaggcttagtggctcatgcctgtaatcttagcactttgtgaggccaaaatgagaggatcgcttaagcccagtagtttgagaccagcctgggcaacatagtgagacttagtctctataaaaacatttaaggctgggtgcggtggctcacgcctgtaattccagcaccttgggaggctgaggccagtggattgcttgaggccaggagttcgagaccaacctgggcaacgtggtgaaacccgccccccatctctgt

SEQ ID NO: 5817 - DNA, 2044 bp, Homo sapiens
actcccaaacctgaggggtccccacaaccccccagcccatcttaacttcctcttcccccaagctatctggtgttggaaagccagcatctagtgtggaaacaagctttctcaccaggtaggccatccgctgtcaggaccattaggtaaaaacagaagtgacaggttgtaggaagtcgttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgaagcagcagcttaccttgggccgtgttctttctcatggcagaagcacaggaggccaagccctaccttgcaagcacaaatacagcccctgctcactttctgttggccacaacacatggccatgcctgacctctgtggggtgaggcagtgcatggccaaggaacaagcacagtccacacagggggctgtcactccgtgacctcagtattacaaaatggttctcaaggagtcgcaaaatgtgtggcagatcatccatgatttgtttcccgtgtgctttacgaatatcctgaaatttttaaaagctgtttccattagaagggatctgttggggatttgaggtgagatgagaaagaccctgcattccagcccctcagttagcagtggtgaggccggagtactccacacgggacagttttaggaaagtgctggaatccaaagtttctccggagggctatgcaaggcgctttggaaaggcgaagcctgggcgcagggagcccagccatgtaggtagaagcagcagacggtgagggaggccatccccacctggccctgccagggccctgactcagtgaaggaagctgttgggatacaggtcattcagccgggcaggaaagatgggatgaagcccagcaagttcacagggatccgggaagttgtgtggctggaaacccaggcagggctgcaccacagggaccatttgctggagatgcagcacttgccacagccaccaccactgacagcatgacacccacaaaaagggagcctccagctgcacccctgctgctgcgagtacttcctcagctgtctgccatgagcttaaggttaagtaccaggagggaggatatgattgggcaaacctcaggcatgtgttcattctgtagcttccagaacatgcgaggagagagcatctggctcctttgtctcgaggaggagggggcaggactctgccagaactcactcgataaaagattttcccaaaaggaagggtgttcagatgacaaaagtccactacaccactttccttggctatctgatgcacccccatcttcccatgcgcgcacctcagaaatcaggctcccacctgacataacacaaccatgcctcacaaaaagacagtggtttatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccactcctactgatgaaatatattgttttggaaaatataggtttaaaaatttttttaaggtaacatgtaatggatgtatagtcttcaaatggatgaataaatgtttttcagagttattggcttt

SEQ ID NO: 5818 - DNA, 831 bp, Homo sapiens
ctctcatgggtctgaaaaggccaagttaggggttgggtgcagaggcttagaaaagtctaggtctcagcattggatatccgggacccccttatactcggccaggctcagggatgaagctccttagagctggccccaaaccaggagctcctggggctgagacagatgcagacctgctctcctgcccctcctaccatcccctggcccccatcatccaacagaagtccaggccagcctgcctcccgctccagtggggcctccattgcgacctgatagacctgtatgggtggctggccccataatcagcatctaccacatcccacgcgcatggggtctctcacagcggcccctgcccatggacagatggactgacccacaggcatccacatgtggtgctgaagaagccgtgaggaaagggggaggtgggaagggcctcgtccagggtgtctggctgcacaggagacatagcagctcccactggcaccctgcatacaagggaaaggcctcgaaatgcgctcaccaaagcctcagagttttattatcaggagctcacattcaggagcaggtctgcttgtcaagagtccaagcacgcctgtgttctgtggccacaggagaggaggggccgcttttaaatacaagcctactcctgtcgttggaccagaacaaagacctactggccagaagcacatgagaggagtttcactcttgtcgcccagactagagcgcaatggtacgatcttggctcactgcaacttccacctcccgagttcaagcaattctcctgacagaagtccactcaagccagccattgtagctagcatcggggctccagcc

SEQ ID NO: 5819 - DNA, 1275 bp, Homo sapiens
atattcataataattacattagattcagaaattcaggaatattttaacatacatatgtactaaaaaataccttagttatcagaagggagtgtttcattttgttcttttaacaaatggttgcttttattcttttgagaatatttgtttcctaggtgaatgagagctaatcttttatgcatgaagggcctaaagtgctctgatttatattaataaatatattgacaatttaggaaacatagaatcctttagacctttcctatagagaagaagagtagtctttgcaaatttgctttacattggtgaaaaaagtcatcatggctcaccgcaacctccacctcctgggttcaagcgattctcctgcctcagcctcccaagtagctgggattacaggcatgtaccaccatgcccggctaatttttttattgttagtagagacggggtctcttcattttggtcaggctggtctctcctggggaacaatagtagtttgaactttaatttactgtgcagttagagcaatttaatatcttcatagagtgcttattatcctatattatataaaatcctgtgatcattttgttaagacttaaataagtgtgaatagaagcttggctttatttctgagtgtataaaagtgttggcatgtacaaagccagtggaaggattgccgtttttgagagtgtcttcttatactgatcacctctgaaataaagcctgtcggtaagattcatgcccagaaatgctgaagacaagcaccagtaccttcagtaccttcagctgtgattctcctgaacagcaacacttgatttgttaactggagctaacccttctcccctcagtctgtaccttacctattgcctgcagttggtgtgtgggttaaaaattaagcaccagctgggcagtgtgtgccttacaggccggaggattgcttgagcccaggagtattgggctgtatcacactatgctgacagggtggtcgcactaagttcagcattaatggggtgacctcctgagagctggggaccaccaggttgcctaaggaggggtgaattggcccaggtcagaaatgtagcaggtcaaaactcctatgctgatcagtactgggaacatgcccatgaatagccatcacactccagcctgggcaacacagtgagaccctatctcttaaaaaagaaaaataaagcaccaatgggatgggaaatttcagatttctagacataaatgagagtgctcataaaaactctggggactttttgttcatgaattaactgatta

SEQ ID NO: 5820 - DNA, 12254 bp, Homo sapiens
atacagggcctggcacaaagagacgcttggatgtgtcatctgcagcaggtgtcgggccccaggctggaggccacgtgccaggctggcaggatttgtccactgtgaagctcgacgcccccgcaggccctgtgctgcccgcccggatccccctgcctcaggatgccctccacaccctccgaattcccagccgctgctctggggcctgcacagagggcttgggcccagcacctggaaactccaaagaggcaaacgggttcatgtccaggttttgtcagatcgcttccgaggctgccctcttcgccgtggctgctgagtgcagagctgggcatctgagtggacagagtggtgctccgcttccttgcatctcctgggccatgcgtggtgacctgtgcccactgcatcgctcctgtgtgccctgtgcatgtgaccgtgtctttcccgtgtattcagtgctgcttcatgtgtgagtttctctgtgttccaaaccccaactacagtgattttacagatgaaccttaatagatgtgaaatctataagtagctattaatctttgtgtcatatttactgcaaatatttcccccactccactagcttccagttccgctttgtggtttgtgagtgaccagtgcatcccgttcctgctgcagcagctgcaatgtgcactgtcctgcaggaagccctcggggtagggcctgggggctgtgggaagctcagcaacaagattcccaacaccagagcttctaagagacctggaacctcttgagtgatgagcgtgtcttttgtgtgctgacgagaggacagagctggtgacccttgggcagcttcaggaagggactgctccccagaaagaccaaggcaggacttataggtgaggactttcagatccaccccaacctccaggaagcgggaggggagagaggacaggagctgaagatggaactgattaccgatggccaagaatttaatccattattctgttaatgaaaaaccaaactctgtaaaacattttaaagaggtttattgggacccctaatacggtgaccacagcttggagaaaaaacaaacccaagaagcctagagtgagtgttcctgaggtgcctggattacagtctggcttcatgcactttaggggacaggcgttacaggtggacgagatatatattggctcagctcgaacacgcgggatatctggaagcaagccttatcggttataggtggattcagagagtcttcagtttgcggctggttaaaggagcaaagctttatctaaaacctagagtcagcgatgaggacatctgcacccgaaacatggggcaggggtgactaacagggtgcatgacttgacttaaccctcgtctgacatggtcttgggtcctgtttgtaactggggctcttattgccacggtcagttctgtcagccttctgatctctgttttgacattaatgcctaaattccaaagggagtgggaacagccaggcgtccaatctcccttcctgttgcggccgggaactgttttccaggtttctctggggtccccttggccaagagcgggtccatgtagtcactgggggccttaggacgttatttttggtgcctgtgttggggcttagaagatcatactccaaaatgagggccccagcagcagcctctgaagcaagtttctgtctgagcttctcccatcctctgtgtctcagtaccactctcactcaaggtgccatagaaatgggaatccttcttccccacagtgggtcctagaaaccagaacccctttccccaaagccagccatacaaccaaaaactagggctctaattttccctgtgcctctgtgtgtacaaactggccataaagaaatggtctgacctacctggcttggctgtagctcctaagacccccattccagagagggtcccacccacacccagaaggagagggcgctgctcagagaggccaaggagaatccagacacacagaccaggctggctttccccactcagtccattagcatcagatccagctaagcctccaatcctatttctacatggctgcccatacttcattgaacctaagcataaaaatgagctgtttatctgaagggtcccttgtatacacattaatttgtgtgccttttctccagttaatctgctttttgtgagttgacttttcagagaacccttgtaaggctgagggaaaagctctcccttggccccacacctacataatggaacctccatgaggtacacataatttaggatgtctatcctaaatgatggggttccaaaaactcccagggtggtgaattcatccagatgccgggagggaggacggtgcactgcaacccaggttgttagtctcagaattgaatggaattccaggacatccagttggcatccaaggagctggaaaactgggtggtgtgggaaataaaaacctgataggtttgggatcatgagagaaagagataccctttagccaccttctctgtttcctcatgagaaaagaaagtcatgtttatctgaggactgtgagtccttttaaattatcaggcccaaggtgttaagatgaggcagccgtcatgtcctactcccccctgcctactcaagctgtgtattcatctctggaaactgcttgctgttgccacaagaggctataaattaatcgaacaatgctacactggacactgtaaccacaccctatagcttaacaatatatagcccatcaatagcttatttttttttgagacggagtcttgctctgtcacccaggctgcagtgcagtggtgtggtctcagcttactgcaacctctgcctcctggattcaagcgagtctcatgcctcagcctccagcgtagctgggattacaggcacacgccaccacaccaggataattttttgtatttttagtagagacggggtttcaccatgttggccaggctggtctcaaactcctcacctcaaatgatccgcctgccttggcctcccaaagtgctgggattacaggtgtgacaacactcagcctagcttatgttattttaatgtaaattcttggtaaacaacttgggacctgcctcttctccccagagtcctggataaccctctctgccctgtctccttcccacctaccgccctgaaggctgcttccgcctctgcccagactgcagatgctcccaggctgtgtcctctgcccgcctcttctctccagccctctctcatggcagtcccacctgacaactcccatggcctcctgggtgtcctgcaaaggctttgtcactggtgtcactcctccaggcctcagataattccagatacacaagcgctctcccaacaagccatattctcacctctgcaaagcatttccaagcatctccgtttcctctgcataagcgacacggcccagccacccgagccctcgttgccatccaccactgggcatcagcttccactcccgtctttctcgtgtcctctggtccagcccctggtgagctccagccaagcaccgcctactgggcctctggtctttacctgttctgttccctctgcctggagtttttttaagtagaaaaatgcgagaatgtggagtgggaatgtaaaatggtgtggctgctgcagaaaacactttggtggttcctgaaaaagtttaggcatacacttagcatgggactcagcatttaccccttaagcacacgccccatggaaacaaaacctgttccctcggaaacgcgcacacagacgctcgtagctacgtccttcgtaacagctggaaggcggatgttgggaacaggccccccaaaatctggccataaactggccccaaaactggccataaacaaaatctctgcagcactgtaacatgctcatgatggtcatgacgcccacgctggaaggttgtgggtttaccggaatgagggcaaggaacgcctggcccattcagggcggaaaaccgcttaaagacattcttaatccacaaacaatagcgtgagcgatctgtgccttaagggcatgctcctcctgcaggtaaccagccaaacccatccctttatttccagcccatccctttatttcccataaagaatgcctttaaatctataatctataaaaacaatgcttatcactggcttgctgtcaataaatatgtgggtaaatctctgttcaaggctctcagctctgaaggctgtcagccccgatttcccactccacacctctgtatttctgtgtgtgtgtgtgtctttaattcctctagcgccgctgggttagggtctccctgaccgagctggtctcggcaggcggagacgaccgggtgtccaccacaggtgaagggattaacaaatggtgcccggtccctggggtgggatattatgcatctgtgaacagaagtgagacactgatacactgaggggactcaggggccaccactgggatgaggcttggaaatgtggcttccaccgaaagaagtgagacacaaacgttcgcacaccgcgtgattccttttatatgaaatatccaaaacggacaaatccatagagacagaaagcagatctgtggtttccagaggatggggaaggaatgaggagtgattacttaatggggatgagctgttgttctggagggatgaaatgttctgaaactggagaagcagaggttgcacaacgtcgtgaatccagcaaatgccgccgaagtatatgcttcaagatggctgttaagtgaatttcactccataaaaggtgtgttttagagggttatgcccatgagcgagcctacctatacatgtgcagtgtcacattactgagacgattctgtttagagcaaagccacctacctcccacgtccctttccagcctgtcttcttagccacctgcctcccacatccttctccagctttgtctccttgcatgcagccctctcagggcttttgaggcctggaggccaagggtgctgggaggtcccactttgtaccctctcccgagagctttgaggggtacctgccgcctctagctgtgccttctctgtgcccttcaactctggagtgaggtcagatcttggctctggggccaccaccagctgtttcaggcttgcaaagttctgtccgacaaaatacagctccgcttccctgtggggggaagcattggccccaacaggccttcttcaccaacggggacagcagtcccttgagtggagccctggactcagggagctctggtcagtgaaactctcagctaggggctaagggtatggggaccttcatatgtgggacaggctcctcgctggggacgctgccaccaggcctgtgaggcagccagccaagttccacttgctgcagctggggctgctctggacggccaatccagacacctcccccctctccaccctctttccatcctcaggtttgcatttcttaggtctggcacttcaactgcaaagtacaagtcctgggctatctcctcctgctctgctgaaggccacatcgatgcttggaaggtagggtcagcccagtcccttgctccacacacccaactacactgatggagcgaccgtctacacagggatcctacggtggggagtgagccttgctggcctgatgcatggcagtggttcctgctccaataagaccaagaataattaataactgtgactaagttagaagctttggctgcatctgaattcaccagcgtttccagctcctgaggccatgtgcggtgtcacctcactcctggcagacagactcccactcggaggatgatttttcatagccagggtcgctctgtggaccttggatggaccaacgtgctttccatgtccaactttgtcaagatccggggaagattctccagcaagtctcttggaaacatgtgcatgtggccccaggcgacgtgaggggtgcagtctgcctgcgttatgcaatgctcaggccagttttccctgagagaggaatgctgccgatcctctgcggtaacccacaaaactccacggagatgcttggaaggaaaagcatcgcgtcctccagatgttttgaaatgttcaagtatttaaaagggaaatggaatttctgtttatccttttaagtgacaattattcattgcgtcttcctggccacagctcattcagcactactgcagatccggccagacccccaggagccgcggcccctgcacagccaaggccaagaagctcccatcgtggaggggggcgcattccggacctgtgaggcccggggttcgtttttatgcctccttaaagggatgagccagagaagaaagtcttcgcaaagcctttgccccaggaggggcggggctgcgcagggcgcctgtggaggccgtggccgggcaggtggggaggctcacacacaggccagaggcttccctggaaactgacgccctagggcaggtccagctcctggatggtcgcaggtgaagaaacgccaggcccaagggtcctgggagagagaggggaacagcgcccaggaagaggtgcaggttcccagggactgcaagggccgccgccaccctcccacaccccaccctcgctgcatcaccagtcagcccagggcaggctgctgaccctcccttggcctcagtttcctcatctgtaaaatggaaaaagaagcatgtccacctcaccagtggtcacagtcacaggtgctgacatggagaaggattgatgcgtcctcctgagtgctgccttgtcatgctataaaccaggaggcctggctctctgcctcccgggaaggtctgtttctaatcctgtgctgggtctgcgtggctccatggcctcagaggctgacaccgagtgtggtgtccctgggtcaccgtgctccttggtttggtccagcaggagaaagggcagcctgccaaggagaaggctgtgagcttggcaggggagaacttaggcgctgtgcctttgggaggctgggatttagatcacagctgggaagctaagtcctgactgcactggccggaaccaatgggctccagtagccggatgctctgccaagtcaggaggtaataaccgccacggcctgggagagaagctggcacagccgtgggcccctgccctgcggtctggcctcgcaggtccccaggccgtgtacagacactgtgcggcagggaagcagaggcagccatggggagcaaccctgtttctcagtgctacatgcctactctccctgagctgatgtctggaagacagtaaaggagacctgaggcagtgctgcccctccttccgtctgccacctcctcagggctggcccaggccctgcagagcaggtggtggtggctgctggtggtaaagcccgtccatccagagcctcgctctgctcccaaaccacccacctcccgctgcacatgtggcagcttcaggagcctggcggggctaagaggagatgacagaccccagcaaggacaggctcagcttcttggggaccgagtcattgcctgttgcttctcctgggggcctcgactgtccgagtgtgttcaggcacacggtgccctgtctgtttcccaggcacttgggccaaggctggacagggaggtgccatgtgggacgaaagcccaggctgtgcagtgctggtcaccgggagtgaccatgggtgaagtcgcgctgtgagtgactgcctgttatcactgaccacgcagggccatcctgggtgacccgctgtgccacaagcaactggttcacattggagcccccctctggagccctgggcaacccgctgccagtgggcctttctcctgaggcccctggagtcccggagcatcccgtgagttcatctgccatacctgtgattgccatgtgggcccagcgccctccaatggaaaagctgcattcagttctgcccgaggatcccaggcctacgacactgtcctcaggctgccagggagcaggaggctgtggggatctgcgttcttgccaggcctgggagcagcagccaaaaagtggacttacgtggacaaaatgttgggccagggaggagccctcggctctggacggatgtctctggtgcttttatgccacgtgcatttctgcagatttgatgcccggcagccagcactgggctgtggccatggtggtgaggcagccttgggtctgcacgaggctcggaggcctccaggaacctcccaggaatgtgactgtgcctggagagaagcgccatctgcacggcgcagtccagatgcttctctcctacaagcccatcatcaaacacacagctgcccagacttcagcaggatttgtgcacaagaaacgcaaaggcacagtccatcgggtgaggcagaggtggaaggagcaccggggtgggagtggaggagcaccgaggtgggggcgcaggagcaccgaggcgggggcgcaggagcaccgaggcgggggcgcaggagcaccgaggcgggggcgcgggagcactgaggctgagctgtctctagtgatctctcaagcctcagtgcagtggccacagggcaaggtgcctcctggtgtgtcctcgcctccaaatcaggctgctccacttcccaggtcagagtcctggggggttgtgttgaccctgagcccccacgagcatccaatccagcagagctggaaggacccaagaacctgcattcctcatggctcccatcatgcttccggtccaggagccaccatccagaccacactcccattcatcccctggccacggaagctgaagccttggtttccccacctgtaaagtgggagtatcaacatcacccacatcaaagggcctggattagatgcggtgatgcccgtggactttagcagccccggtcctccaggggccctcccagggagctgaggcccgggtggtcctggcggccgctccttctccaggccgaagacaggaaggtctcttgggctgacctcaggcaagaggcggggtgggtcacggcctccagggccaggctggggcctccacagaaagcccgtgggtggcgagagggagccggctggggtgactgagggtcgctgggtagatgagggagggacccggggttcttgtgttcacgtgtgtatttgccccgtgtttctgctgacatgccacgtgtgcaacaaacaggcttggcgagccatccccaccacccaggccgagacgccagacgtgactggcaccccagggttccctcccggcccccagaggtaaccccaatgctggtttaccacagatgactcattctgcctgttttagggttttgagtaaatgaaacccaacagcgtgcagtctttttgcctggcttccctttaaccacgtctgagaggctcactttgcggttgcttctgtggctcctggacagtttcccttgtgcggacacaactcagtgagagcaccccttcttccatttgtagactttccaaatagtccaggcgagagaggctcaggtcttgagttcagggaggggcaatgcacaagcagacgccaagtggaagggagtacacccctcccttggcggggaggccctcgggctggtggggatgagcgcccctcagacggcacctgcgggtgacagggtgtgacattctgctgtttctcggaagtaactcgcaagcagcatgggggttcctagtgtgtttcacagactctcaccaaatgttagggttcactccttgtcctacagcttaaatacaccaaaagtgagaaaattacgagataacatttccctcagagacccatattctgtgttaaagaattcttccttctacctaaatccatctctttacggtcagatgtcattggttgtggtattttgtccattttcagctttgtttagatttttttgacatgcaattaaatgcccatatttaagacgtacggtttgataagttttgacattctgctgcacccacagagccatgaccacaatcgagaccatggacatcccctcccccaggctggcccctgccccgtccctccaccctcctgctcctctgatgacactgacctttctgtcactgtagattaattcatttctgtcctgggtaacacagcgtgtatactcttattgcctgacattgtctcacagtgtaattattttgagattcatccaacaattcatcctttcaatgctggggagcactagttgcatgggtgtatcataattggttcatccactgacccgtggaggacgttcaggttgttttggattttggtgattacaggcaaggttgttgtgaacgtttacgacacagtctttctgtggacgttcccagaacagacatgtctgggtcacatggtgactctgtgtagctttttaagaaatggccgaaccgttccctgtggttcttgtgttatgatcctgccaacatgctgcgcgctccagttgccccacatcctcgccagcccttggcagggccacttttgaacatgttagccatgctggtgggtttgtaggcacctctcatactggtcttcgtttgcacttccctaaggactaaatggttgtcagcatcgtcttgcgtgcttctgtctgttaatatagcttctttggtgaaatatccattcaaatattttgcctactttttaattgaattgttttgtctcattattgtgttgaaaggcttcttgacatgttttagaaagaagtcctttttgaacatggtttgcaaataatttctccagcttggcagcttgcctctttatagtgtctcttaaagggcaaaagttttaaattaataaaatttagcttattggttttttcatgtagtttgaactttttgtgttctatttaaaaaacctttcccaaactaaaagtcaccatgattttatcttatcttcttcttacaagttttactgttttagttcacacatttagatttatgacctattacaatttttttttttgagatggagtctcgctctgtcagccacactggagtgcagtggcgtggtcttggctctctgtaacctccacttcccaggttcaatcaattttcatgcctcagtctcctgagtagctgggattacaagcacatgccaccatgcccagaaaatttttgtatttttagtagaaacagagtttcaccatgttgcccaggctggtcttgaactcctgacctcaaatgatccacctgcctcagcttcccaaagtgctgggattacaggtgtgagccactgcatccagcccaaagttaattgttgtatgtggtgtgaggtaagggttttgaggatttgtaattgttttattttgttgcttatgggtgtccaaatgacccagcattccttgtggaaaaggttattctctccctgttgaattgcctcagcacatttatcaaaagtcaattggccataaatgagtagtggccatagatgagtaggcctgggtgttgttctgtctcattgacctatttatctgttataatgattatattgactgtcttgattaaaatcaagtaatataaattcttcaactctgttcttttttatgcttgctttggttactccaagtcctgtgcatttctgtataaaccttagaattagcttaccaatttctacaaaaatcctgctgggattctgattgggattgtgttgattctggagatcaatctggggagagttggcatcttccatgaacatgctatggctccatttatttaggccttttttcattcctctcattgatgtttctcagttctcagtatataggacttgtaaatcttttgtcaagtttatttctaagtcctcagtaattttagctttgcattttgagctaattatagcttcacaaaaagttgccgaatagtacagaggggtcccacattccattcctcagcttcctacaatgcagcactttgcagagctacaacaaattcttaaaaccaggaaactgatatgggcaccacgcaagtcactggatgacggagctcatttggacatcctaggtttccgtgtgtttgttttattctgggtacgactccgtgtggagattctgcgatgtgtggccgcatatgtggatttctgtaaccacaaccacattcgagatgcatgaccgtccatccccacaggtgtgaggtgtgccccgcggggcccttctctaacccacagcacccgccggcgtcactcatcctttcaagagtgttatgggaacggagtgcggaatgcagcctttgagatggagttttctcccagagtctgtttctctccgttgctgagcacgttgtgtggtgtggaggcaccacgatgcgtcggacacgcacctgctgacagacaatggggctgttcccaggttttcgctgttccaaataaagctgctatgatcgtttgtg

SEQ ID NO: 5821 - DNA, 1310 bp, Homo sapiens
ccacgctgggcgcacagcccgcggtctgtcccccgcactgcgggacctgagaacagcagactgccggctcctctcccacaagggagggcttggttgccggctcagacgctccccgcccctcgcctccggccaccagcctctccgcccggggtcaacccttccagcctttcgctctcatctaaccggacgcaggaccgacagcctctccagggcctacccgggcctcgcttcctccggtgccaagctccaaggtctcctcacctctcgcggaggaccaagccagaccggacgctccaggcccgaaaggcaactcccctcccaccactccctgactcgccggtctttcctcccaactgcagccgctgaaaaagccaagtcctaaggtccccctccatcagcttccgggcctcccttcacggctgggcccgaacccccagccctgccctctcgccatctcgcttccccgagtcgcgaggccgagccccggggctggacggcttctttccccggcttcgcgcccgcccggcgtgcggaagactcaccactgagcgcggaggcctgcagtgtggcccccgaggtgccgtcgatgactttgatggtcccgcggctagtgacggccaggatggcgttgagcgcagggtggtaggacaggctgtgcagcccgtcggcgtcgcagtgcatgcagccgtcccgcagcaccagccactctgagaccccggccgcccccgcccccgccgccgaggagcagccggggcccgaggccgccgcagccgcagccgccatcttccggcctgcgctcagcacaatcacactgggaagcggctcagtgacagtcccgggaggtgcagcaccaccaccagtcaccatccggggccagggggcaagccgagcgcgttagccggaagtgaagtcaggcgcccgcacgcacgcggaacgtcgatcgcccggccggaggggccaaactcggagggaggctgacgggagagggggagaagcagggagggaggcggggcccggggcgcgggctggaggccggcgggtggagcatgcgcgggagggctcgcgcgtgccacgcgccgcgggtctggccagttccgcgtccgcagcgtcccagtttcttcctgtgagcctggggagtggcggctgccgagtccgccccgctcctcgcgggggcagggggaggggttggcctccgtgcatttccgctaggtggggacccccgcccttgcgacctgtccggtacgcccggaggccttttgcagcggttccagctgcgccttgaccgttcccggtacgcacggtgcagctgt

SEQ ID NO: 5822 - DNA, 4852 bp, Homo sapiens
agggctgaaccgcagctgccttcaacaaagattaagcggctctgcgatagtcgctgcatatacgaggaaggaggcgacagggcccagctgtcacacagcttggtgaagaagccaggagacataaacacaagagtgcaacggaaaactttatatgataaacatttatgtcgggttagtggagcgcgaaggaagaaggatctcttgtgggtggggggagactcacagaagcggtgcaagctcaacaggtaggcaaggaagggcagaacacgtaggcccattttagatctgcagtgtatgtcagatgactggtgtttaggagatgaggaagaagccatattatcacttctgcaaggataaaaaatctgatcctccaagcaggaggatcgcttgagcccgggagtccgaggctgcagtgagccatgatcgcgctacgcacccagcctgggcttcagaggaagacgctggcgcaaaagtaaataaataaagaagatggcctgcaggggacaccaggtaaagggtattatattttgagatggaaagattttgtgcatgtttataacttttagagaaggacacataagagatagaaaaataaaaaatacaagagaaagaagaaagcgaggtctcgggaaatatgaaggggaagaccaaaggcccagatgaataaaaacaggtgcattattgcctttgatggggtgaggaggagggaaaagtcgggtgagggtataggtgagcatgtagatacgagggcaagaaggtacattttcttgtcacctaagacaggagaccaccttcgtaaataggaagggtggttttggatctttgaggaagcaaggatgggtttggatccttgaggagaaggtttggaaaagccattgtgagaaatgaataaggaagcctattagaaaaaaacaggtgggaagcggtggtgcacacctgcaatcccagcactctgggaggctgaggtgggcagatcacttgaagtcaggagttcaagaccaccctggtcaacatcgtgaaaccccatctctactaaaaataaaaaaattagttgggcttggtcgtgggtgcctgtaatcccagctactctactcgggaggctgaggtaggagaatctcttgaacccaggagatggaggatgtagtgagccaagatcgcatatcactgcactccagcctgggcaacagagcaagactctgtctctaaaacaacaacaacaacaacaacaaaaaaagaaactcaaaagcaatatgtcaagtagagtaaaaagctgaaactggagatcatatctgggaatagccccaattagggtctgtctccagcaacacccagaagcttggattttggactggaaaagacagatattagggatttatagggtacatgaggaagaagaacaaagggtcaagaatgttgtaggtggtactggcaagagaatgattgaaatgataaattatgggatccatgctagatagctggtaattaattgagtcaaaagagagaagttaaggaaccaggattaaaggaaatctgaattcaatatagcaggaaataagttttagtcagattggatattggggtttaacattttagagtagcaatagtccctggtgaggctggatttatagttgggttgtccacacaaagtcaaagtcttctatgagtaagaaaaggaataagatgaaggagaaggctatgagccagggacccaaatcctcatttaatgagacacgtgtgtgtgtgtgtgtgtgtgtgtgtgtgtgttgagggaagctataaagagcaatgagcagaggcagagagggcagagttgggcagaatgacccccaggtgtaggggtttttccctgaagatgaaaacaatggaagttaagacaatgccaactttgccttctgtcacaaggaacataagagatcagtttcaattcaattcagcaaaaagtaaaacaagtgtccaccctggacaaacaccaggagctgggctaggcattagagacccagcagtgaacaagacaggcccagtccctgcctcatagagctcacagttatggagagaatgacagtaaagaacagatctccattgtgagggtccccatcactgtgagttccagcatctccaagcttagcccagcctcagcccctacagaggcagagaaatcaagataaggaagaagttatgggaattgcccttgattatgcaaatgtccccagtcacactaggatgcattctttttttaaaaatttaattttaggttcgggggtacatgtgcatgtttgttacatgggtatattgcatactggtgggcattaggtttctagtgtacccatcacccaaatagtgagcattgtacccaattggtacctttttaaccctttccatcttcccaccctcccccttttggagtcaccagtgtccattatttccatctttatgttgatgtgtacccgtattcgtccattctcatactgttataaagaactacctgagactgggtaatttatgaagaaaagaggtttaattgaactcacagttctgcaggctgtacaggaggcatgactggggaggcctcaggaaacttaacaatcctggcagaagggccaaatcaagtgcttggaagccagcacttcttcacgtggcagcaggagagagagagagagaagggggaagtgctacacaattttaaacaactagatcttgtgagaactcactcactatcacaagaacagcaagggggaaatccacccccatgatccaatcacctcccaccaggtccctcccccaacactgggaattagagttcaacatgagatttgggtggggacacagagccaagccacatgagtgcccattgtttagctcccacttataagtgagagcatgctgtatctggttttctgtttctacgttcgttgacaggataatggccttcagctctatccatgttgctacaaaggacatgatttcattctttttttttttttatggctgctggatgcatcctttaaactaggttattcctttcctgctgtggcttctgaaaggctatcagagagtgtcctttataaattgctcacacatgcacaatgtcagaaaaggaaaaattcctttcattcccagtcaagaagatcagggcctctgtaccctttgtggttatcctttctgcttcattttcacacacatatcttatttgagctttcaaacaactctgccagggtggtcagtgagccttattacaattccaaaaatctgaaaagctctggaaaacaaaagtatcttggtaactccattagtagaaaatgacctgacctcaagtaaggttgcttagtctttatttgtttcacttggtgtgtttggttccagggtggggcacagaccctgctggtggtattatgtaatataccacatgtgcactgtatcacctttctaggatccaaaaggctgtgaattctgaaatacgggtggcctcaaggatttcggacaagggattatagtcctgtgccactctcctttacaggtgatgaagaaaccaaacctgaaaaataagtgacactaaacagattggccccagactttgctccggattgtccagcaaatggcaaaagccagtggatgttaatcataaccggaagtgacaggattaattttgatttttagaaagtgtaactagtagaaatacagaagctagatcggtaaagcagagcctgggtgcagggtcaaaaccaaaagcccttgcacttttccttatgttcaccacctcccgcgattgtgttcatgtctttgcctcccattcctgatcccatttctgatcccatttcccatcccatttccactgtatctaccctctcaccccaaagttgctttcatgggttcaccagctgactattatattacccactccagcagacatctctcaatcctttgtgactagattattcagctgtatttgaggccactggccaccctctaatcccgaaaacttcccagacccctggcttttttggccccattctttctcgctcctctctgacttctgctctggctctgtcctgacctcctctgcctcccctggttcttcaggattgggatcccaagacaccagcctctggttttcaccttctctagttcttcctggacaataccctttgagttttaaccccaacctccatgctatgaggctcctggattcctacttcgtccaggcttcttccctgagcttcagattcatatatcccactgcctaccaggtccacagctaaccccagagttgaattgtggaaggtgaaaacaatttctcaccaaatcaaaatttctaagctgtaaatgtgatgtctctttaaaaaaaaacaacctattttattattactgttggcaaattattagtaacatgcatattcaaccaccagaattcagttaactgtgtatggcagaccttttataggccagtcattgtgctgggcaaggcaatttacaagctagtgaggtcaggggcagagataataaggcaagttcacaaatgccaatagctgaagctggagagcgcgtcaaagcgagggagggagcagtctaatccctgaggcttggcagtacctgtgttcacttcccctccctttacatcctgttctgtatcttcccaaaggtctgcggaggcatgcaagaggaggaaagtttggtggttgttaagataaagaggagtgactgtttttgaactctttcttttgcttaagttttggtgcctctttgttttcctcagttgtcttctaaaaacaatcagcactgtagctgctttagactaagaacatatataggtccttaaatggattcttatattaataatcatagtactagtccgaag

SEQ ID NO: 5823 - DNA, 2929 bp, Homo sapiens
gagacaaagtctcaccgtcacccaggctggagtgcagtgtcgcgatcatgctcactgcagcctcaatctcctgggctcaagtgatcctcctgcctcagcctcccagttagctgggactacaggcatgcgccaccgtgtctggcctctattcttgcaattgaatgagatgctatgaggcgctgagcgacccacaggaaagtacttatcaaaagctttgtgtcatgagaagatgcggctgtggaaggaggttcaaagcttgcacacacgcacacacacacatgcacatgatttggcttccataaagctcgagtagaatattaaatattgagtactgagtttttaattgtaaacttaagatctcatccttaactttacatatacatagataacagggtggtcatgaaaagcactttaacatcaggacagatgttaagttctgaggttctgttttcaactgctctacatacaaaatgccctacaagcaaagaaaggcttaaataaatagatggggatgaacatgatgcacgccgtggtgacatgagtggtgtgcaggggtcggacagtgcggaacccgggtgggcaggagcacattgtggagacacaagtggtggcatctctgggatgtaggggaggatgtggggggctccttcaaggtggagctagcagaggccatggctcgggaggaagacaggacagggacagtttgtgggccagtgccacacgctctcctattggcttcatgggcctgggggcagccctgggtagcaaaggacagggccaggctctccccctggagacccagagatggcggtggtcctcttaggacaaaccctcaccagccccgccctctgaccagcctgtcactggtgctgatgtcaggtggtggccagtgaggaagggggttattgacagccctgcctgtggctaaggcacacccagcctgggagccccaagcagctgacctgagcaatccagcgtccctttagtcacagacgccaaagctcccagaggcagttccactgagtgagggtgacaagacctaaaaccaccacctaccctgctgagcaggacccccaccccctgtagcagggagaggctcctgggccccagaagctggagggggtggtgtcttgagccctgacacctgctgctgctatcttgacccgaccacccgccccaactcggaatgccacactgtgaccactggggcacctcctgattatccaagaaaagtggataaaaccaaacgctgctgtctgggcccagcggaggctccctggggcctggctagggtgcgggtttcacactgtgccccagagacccagcagggaaggtgaggcggtggagggagtggggggaccaagaggctgagcagggaaggccacagatctgccaggaagaaagtccctgggctccagatctcgggggcggggggcccgtgccacgcactctaagctagctgaggaggtgatcttaaatttaggagacgagcccactcccccgcttcctgcccctcagcagccacaagatgggggaaggtggctggtgcaacaggagcctcagctcccagctccatctccacagatcttcaccgcacacccgtgtgcatccacatgcacacccgtgtttacaatcacctgcacccccacggcgggatggcgagtccggtcaaggtgcagatgtttggaagctgagttcctgggtccctgagggttcctgaccagaggccccagctgctgcagggactgatgctggagagaaagctgggaaaagtgctgggatctgtgcttcgtcccacactagcgccattacttcttccctccaaattcaggccagaaactggcatccgggctctggaaattgccttgagcagaggaaacactctactcccgctcggcatcaaggcctgggtgatggagagtcaggcgtggtgcccctggggcactgcctgccctggcacacaggattaggacctgctggaggcctgcaccctactcctggccgacgtgacccagatgctgaggcaggactggcactgaggtccactctgaaggatggctctggagagacagcgcctgtgtgccacctgtgagcctctgcactgggggtcctgctgcgaggtgggaacggctaccacccctcctgggagggcagggactggccccgcacattcccaggacttggaagctctagagacaatcaggaaggaagcacgcctcgggggcaggcttgagtgccgtctgggtggaagccggagacgcgcaggccctgcggagctggatggccccatcaaggcctcacaggaggctggccaggctggtgttgggtccattctgagcttggaactgcacggggggtggaccgtctgtccactgtggggaggagaggacatgcgagtgaggcactgtgggacatgagcatgggggcccgccttgccctgtcactgcccaggccctcccactcggtgcagatggagccctaaggtcaagtcccagctgcactggtggatctctgggtgcctggcacgtcactggacctgagccctgtcttgggatcacaaagcccatgcgccagccgccctcatagggcagaacagggctggctgggcagtgaaagcccaatgccaggcttctcgccagccctccagggagcccatggccagccctcaggcaaacaggcgctcattggggcaggacgcccaatgcccatcctgaggcagcagccccaggcagcccactgcacatggagcaccccgtctcctgtcacctccccagggccccaggcgagtctccggaccttagtttcgtaatctggaaatgggggagctgcggtaacagcaatgatacccgctgagtgcccgccctgctcccagagctagctggccagccctacccaataggtatggctgctgtctgcctttccgggaaga

SEQ ID NO: 5824 - DNA, 1211 bp, Homo sapiens
ggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctactgtgttgtctcactattaaaatggaattcgttttttcagatcttttctaatggttaataaaacaaatgtcagatcat

SEQ ID NO: 5825 - DNA, 1603 bp, Homo sapiens
ctgctttctagtagacaagcatctactagtaattgatgattagattatgcccaaaccctctagtggaagggggagggagtgaatgtattctagccaaatcatctgttgactagaaaacggctcttctcctctgctctccaagtgcaacaagttccagataggtagcatagcagcaaattgtacatacctggtgaccccctcaggcattctaatgttctccaaatagaaacctaactaaccttcagtaaggcagatttttttaaaaaagcccaacttcatctgcctgtatatgttctcagtgatattttttatgaatcctaagacctataaaagctcaaaatgcagattttgcatcaaaccatttatcgtaaaacattgaggtgcagtttttatacacaaaactttctatctttttaagaattctgtttgtatggcttattgcctaataatttttgatattcatgtaatctcagtaagcgtcttttcttagaaatatgtgtatatatattctattctgttagattctgagctactttttaatgtttaccttacagtgagattctcccaactgaaagcaagtggagtttatttttttcaatcttgattgttgagagagagaacttctggtttaaggtagtgataggttgacatttcttgatatttccttcccaaattggaatttgctattgaagacatttaaaaagtataaaaaactaagatataaacactaaacatttgtgaaaaacacagttaacagtcagccatttgaagggcctgagaaaattttctgttactctaatatcatttaatgaagctctattaggaaggcccttgtagttttcactttgagaaaagtatgtttcagttggctaacaagtaagtagaatgcactaagtcagacagccattatttttatctaaggcagtcagttatttctgtcctcattcagtctgctgtcagtgtttctctttcttcatccattcagagattattattcccagtaaacaagaaatagagggagatgggcaaatgatatcttttatccttaaatatgtggttttatcacaaacaaagccagataaagaccagaaatagccctagaagtacacagtaagggttagtttttttatatacgatatttgtctgaattaaactccagcctacttcaaatcctgtatagcataaattatcatcattgtcaagagaactgggcgttgagaaaaggagaaaagcacacctggattcagcagaacgacattaaattattatgtctttaatatatctgagatatctcagggagtgaagccattaactgtggctcctccctttctctcaaaatgaactggagctggatcaatttcttcttatcaaagattagtctatagaaaccaaaatccacatgagccccataaaaattgcactttacagtgaaaataacagttactctaaattcagaataaaggcatatcttagaaaatgatgtattacaagaaccaaagaaacattttgaaacatcatttagtggcctaaaaaagaggcaagaattcctggctattataaacaggagaatggagccaaaataaatgtaggcttagaggaaaaa

SEQ ID NO: 5826 - DNA, 14086 bp, Homo sapiens
atgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctgccgaatggaaacccgctaaaccccgttatggagtctgctacaattaagcatctaaccaggaattgtctatggacacaactctccaggcaattcatgcagaaagtgtgttgacgatttcctgtttcttgcagagcgcttcaccgttaaggctcttagtagctggcgattgtaaagcacattttccgcttcatgaaaatacagtgctcttcttgtgtttgtaaccttggaaagtaagtctgctatgataagtttagggaagtggcggggagctactttcctaacatatctgtgattgttttgatacttctcagtttctcgcgggcatttcctgcgttctctatagggctctcttgcactgaataaggaaaggaggaattctctctgcattgaggctattatcgcacattgtgcggtggatatagtcacgcgctgggtcgtagtagcgtgtcgtttatttcagtccagctcactcttggtagaatccctttattcgttttgttgtttttgatagtctctctctgcttcccaggctagagtgcaatggcgctatctcgactcactgtagcctccgccttgagggctcaagcgatcctctcacctcagcctcccgagtagctgggaccgtagacgcctgctccccatccccgctatattcgttctttaatacagtctctcagcttgttcagctgccacttctgtgcagctcattagcctgatcggtgaaaactaggcgagacgcgcacactgaccctgcagtgcatcttgggagttgtagtcataactaatcaatggtcttgttaaaacgtgcttatgttttgaccagatcgcttaagtgtggacacccttcagcagtacactacaacgtgggtcagtgtacagaacacatgctgatagaaataatttcaaaatctggattcatagtttttttttttaatctagagacctcagaaaatgtacttgaagaaaatcatcataatataatacataacaatagagccaattaattgatgtgatgaaagtggacaaaatgtattttgacctcagagaaaataacatttctgtcttggaagagtcagagaatgcttcacacaatttttgagcctgatgttagactctccagccttctgtccaagcctcaccctttggttactccccaggaagactgaacttgggaagaggattgtgcagaccctggagtcaggcttggcgtttgggatagggaatactagagtgcccacagcatggtctggaaaagggaaagtgggctgcaggtggctacagtcccatgattccatggatttcagacccctccaaagcacagggctcagtgcttatccaagtctgagggccccccataaccacatcttccccagcagatgttctttgcttcaggcagtcatcaaagttccacttcaaagagttgctaaccaaataagcccacaatcttccttttttgttgttttgaataagtaatgcctttacacatatgaaattaaaaagagaggccgggcatggtggctcacgcctgtaatcccagcactttgggagggcgaggtgggcagattgcccgaggtcaggagatccagaccagccaggccaacgtggtgaaaccctgtctctgctaaaaatacaaaaatcagctgggcgtggtggtgggggcctgtaatcccagctacttgggaggccgaggtaggagaatcgcttcaacctgggaggcagaggttgcagtgagccaagattgcaccactgcactccagcctgggggacagtgtgacagactgtctcaaaaaaaaaaaaaaaaaaaaaggcaaagatatatagtgaaaactaagtcttcttttagtctttgtctcctgccactcatagaattttcctcttggaatcacctctattccattttcctgtgtatgttgccagagcagggctggcttcatggtggtgacctgtacagataggcacttggtttaatgttttgctgtcactaacttgaaattcaggaaagtttctggacaagggccctgcggttttattttgcactgggcccacaaagtatgtatctagtcctattccagagatattctatgcatatacaggtaattatatgtagatatgtatgtagtggtccagtagtggtccagggcctgttaggaactgggcggcacagcagaaggtgagtggcaggggagccagcatttcggcctgagctctgccccctgtcagatgagcaggggcattacattctggtaggagtgagaaccctattgtaaactgcacatgcaagggatctaacctgtgcactccttatgagaatccaactccccctttccatggaaaaattgtcttccacaaaaccagtccctggtgtcaaaaaggttggggacctctgtagtaggctaccatctaggtttgtttaggtacactctatgatgttcacacaacaaaaaatcacctgatgatgcatttttcagaaagcatccccattgttaagggacacatgactgtaatggaatactattcttttccttcctttttattttttgtggagacagggtctctacatgttggtgcccaggctggtctcacactcctgagcttaagggatctgcctgctttgacctcccaaagtgctgggattacaagtgtgagccaccatatctgaacccctgtcccccactttttttttctttctttttttccatacacagtccaggctggagtgcagaggtgtcatctcggctcactgcaacctccgtctcccggattctaacgattctcctgcctcatcctcctgagtagctgggattataggtgtccgccaccacgcccagctaatttttgtatttttagtagagatggggtttcaccatgttggtgaggctggtctcaaactcttgacctcatgtgatccacctgcctcagcctcccaaaatactgggattacaggggtgagccaccgtgcccaggacagccttttttgggtcagtgtgtatatagagctaactcattctacttaatggctacatagtatcccactgtgatagccgcaaaaggcagacaaatcctaggcagacaggggcaggtccctggtgaaacccttcaagctgaggacagtttaaaggctagccacaagaccaggataaatccacagaccagattgagaacctctcttcccatttggcgtgctttcttctgattgatccccacccttcacctattttacacatatcctttcctaattgtttttttacactgttgtacctacctttgagtggtgctgttgttttagccttttttgcatactcacaaaccaatcagcatgcacgccttcattctgagcccataaaagctgtggactcagccgcactgagagagagaccacctgactttgagtgagggaccacccttgcatcctctctctcctgagagctgtttcatagttcaaataaaactcttctccaccctcctcaccctttgattgtcagcgtaacctcattcttggacgctgaagaaaaattcgggacccaccaaacgcagatacaaagaaggctgtacacactgtggccctttgccctctgctggtggagggcaaccgtcccacacaacgcgatgggaagcagcagtggggcagagccagtcctgaagccacgggcctgagtggggcaatgggactgatagagctgttaacatgccactgtccgttggcctgcagacggcagaactaaaagagtgcttagcatactgtaacacctctggggcttcagggtcatgagcacccctgtttgggtgccaccacatttccctcaatgtgacacacctggtccagccacaagccccgcacagagcccactcctgccctgtactcgttcactcacacaccccctcctgccaggggctgaggccatggtggctgcaggattcgtgcctgagcacaagccagacacatcctggtgggccgagtagttggggtgttgctggccggaggtctccagctgtcaaagtggccaagaaaaatcctgcatcaactgtacaaatgtaccctaatttatttaactcatttattgtatatttgtgtcatttccaatggttcgtaatttcaaacatatgattgtgcaaaagttgttttatgtgtgccaatatctttgtaggttaatttcctagagcaaagtttttcaacctaagcaccactgacatctggggctggataatttgttgtgaggggctgtcatgtgcgttatacgatgtatcctatccacccctatatgttatgaaaaatatttcagtggccagaatcctttcaatgacttaaaaagcccttttcatcctgcttctgcctacctctccagctgcatcttagtacccgcacactcttttttcatactcatgcccctgcttgctgtctttgcacaggtattctctttgtctggagctttcttcctcaccaatcatctcctaataactcccattttatcttttaaatgttgccactattatcacttccttggaggagccttcttggactgcctatttcaaatcccctgggttttttttttttctttgacaaaagccacattcgaacaaatcccccttggaatgttacaattaccaaaaaatccaatttaaactagtttaaatgataagagaatttattggctcacataaatgagaagtctgaagataaggtgaacctcaggttgatttgagtgacttaacagtatcagcaggaacttgatttccttctacctctcaattttctttctgatgtcagattcatcctaaggcttactccttttgtatcataaaatggtggccaggatctcccaaggttatgtagttctttgtccatatcaaaagagagtttctttcacatatttcacagtttcaatgtgattaaattaatttaggtcacatgtccgcccctaaacctagagttttgtggtctagagaatgtcaagcactgattggccagggcaaatcaaggcctatccttggaactggaagttacgttaatcccacctaaatcccatgaatgttactctatgaggtatcggtaaaatcgatgctaggaatacaatcagaatccattatatcctattacacgcttatagcaccatgcacccctccattgtagcacctgtcatacttgtagctttatatttatttgtatgatttctgattaataactgtcttctcatccagatgaaaaacctctattagtccagggaactgcattttttctcaccattgtatctctagtctagcacagggtgtcaaacatagcaggttctcaataactattgaaagaatgaaacttcccttagaagtttactactcaatttgacattccctttagcaggcaatttaatagctaccatatcagacttatattacatatttgaaagtcccagactgagatctctaatttctatctccaggcagtcagttcttgacacaccactgagtaagattcatggaataaatctgaccatattatattcccttgacatctttcaagttcctgatttcttttaggataaagttctttatgatgccattcaaagctcttcatggtttggcccctatctggctttctattctcaagagcaaaactatagacttctggccttcttcagggtgatctttctctttcaatcatagtccctccccaaccactcaccaaatatcagtttttagaagtcttgtctcttgcagggagtagagagggggcagtaatagtttattcagggattcccccatatctttcctgggtaaaggtattctagaaggaggcagaggaaggaggctagaggtcccactgtttggcattcaggctttcacttaatgctcactttagccctgcttcacagtcccctactacctactgtgactaatattctcaagtcaagagtctctcccattctagaaaataaatcaggctcctgggatgtggtgatggtgttataggggcatgtgtgggtatgagtgtgtgtgtatgtgtgtatgtgtgtggggtggcagtcctttggttatatgggattggggaatagacccaggaatgtaggtgttctttatataggctttcacccttccctaaaattttctgccctgatcctttctaatttttttgtggaaagaattagctcttttaatttatttattttattttattttatttcattttattttatttttttgagatggaatcttgctctgttgcccaggctggagtgcagtggtgtgatcttggctcactgtaacctctgcctcccaggttcaagcgattctcctgtctcagcctactgactagctgggactacaggcatgtaccaccatgccaggttaattttttgtatttttagtagagacgggctttcaccatgttagccaggatggtctccatctcctgacctcgtgatctgcctgcctcagcctcccaaagtgctgggattacagacgtgagcgactgcgcccggcatctttttatatttttaaaaggtcacatgtatgtcctttcctgtgaactgtttatattctttgccaaagtgctgggattacagacatgagccactgcacctggccttacctcttctttttttctttaatcacctgtggaggcttttagattgtgccttttgctgtcaagtctactactactcttccatcggcttgtcatacaaccatttgttgaaatttcttttgtattttgtttgccttttgggctctacactttttaaaaatttatttagctgtcaaagagatgacatactgtgtatggttaattttccatgtattctggagttctaatatattttcatggtttttaaatgtttagttctttaatcaagttggaatttttaaaatatatatgaagtaggatgctaatttaaaacttttcctccaaatggatatccatccagttgtctcaacatcatgtatagaaaaaacaaattgaaaatgctatcttatcatattatttactaaatttacatgcatatacatatacatacataacatatatctgagtttgagtctgaattcactactgtttcaattgctgtagttggtcaattctagtatgacagagttttaattgctacagttttggaatgattatggggttacttttgagacagggtctggctatcttgcccagactggtctcaaacttaccggctcaagcaatcctcccatctcagcctcttaaagtgttgggattataggtatgaaccactgcacctggccctggattgcattttgactgtggccatagaagtttccactcagatcttcaagagaacctactctggggactacaagtgactgacagccagctgccacccctttggaactaccatgcattcatgtcaatgccacatatctctggagtcgcccccagctagtggctgagcacagcaggagtactaaacttgttctttcttgcccagtgcagaactcctctaacgggcaactttggcttggggaacttctcatcagcctggatgagactatcttagaactacagtgtagtcgaggctctttctacccaatatttccttctcttctttttacagaagtcagacctgcaccacagtctgaagtctctctgccaattcctgagccttcccactttatccttcacaaacatttcccccaataaatatcttgcatgtctaatcccttcttggcatctgcttctctgaggaccagaacagacaggtggtttaccaagtggtgcaagaaaacagatagtaagatgggttttgggcaatggcttacttggtccctggcacaaagcagccatctgagtcctgatttagccagcagtgacctaggaaaacatcccagagaagggaaatcctcttgctcgtgcaatttaggcatttaaaagatatggggaatacgatgcctacaaagaaagcagagctggccaactgttactaagacaagtaatgccttgcagatggataatgagaaaccgagagcacttaaacagttaaaggctaagtgtgggagccgggggcttctctggagcttaacaaacttttatttcctgcagtggaagagcagaaatgggattggatggtcacagagctctaaagatatttgaatgctcagcctagggagatccagtatgtagtcagggcgctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggagttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggtgatggctttgaaaaagtggaaatgaattcacaccatggcagcttttaacttgaggagaagatagctatttattttggcatatttatgtggttactgctcacttactagtcccaattgttttgtaaccactttttatttattttttgagatagtctcattctgttttctagactggagtacagtggtgcaatcttggctcattgcaacctctacctcttgggcttaagccatcctcccacctcagcctcctaatttttgcattttttgcagagatggggtttccccatgtcacccaggctggtcttgaactcctggactcaagtcatctgcccattttggcctcccaaagtgctgggattacaggcgtgagccaccacatcgggactgttttttttgttttttgagatggagtcttgctcttgttgccaaggctggagtacaatagcaccatctcagcttactccaacctccacctcccgggttcaagcaattctcctgcctcagcctcccgagtagctgggattacaggcacctgccactacacttggctaatttttatatttttagcagagacgggttttcgccatgttggccaggctggtctcaaactcctgactttgtgatccgcccacctcggccacccaaagtgctgggattacaggttttagccaccatgcccggccacctggcctgttttataccaatttaaagtgtttttttaggcttcacatggtggttcatgcctgtaatcccagcactctggaaggccaaggtgggaggatcgcttgagcccaggagtttgagatcagcacctgggcaacagagcgagacctcacctctactaaaaattaaaaaaaaaaaaaaaattaaccaggcatggtagtccatacctgtagtaccagctacttgggaggctgaggcaggaggatcccttgagcctaggagttcaaggttgcagtaagctatgattatgtcactgcactccagcctgagtgacagtaagaccctgtctaaaaaataaatagtggtttttagatgatcatctgcaaatatttttgttctttccctgtatccctttttaatctcatcacattgattaggacatccagaacactggtgattcttgttttgttcctgactttaatggccatgtttccagtgttgtatacatgttcctaatttttgatacataccacttgtgacgttaaggacatttcctgatattctaaactctctaggaaatggatattgaattattaaaaaaaaaagtctctttttagcctgggcaacatagtgagacccagtctctaaaagaacaacaacagcaaaaaatttgctggcatgctggtgcatgctggcagtcccagcacctcagcaggctgaggcaggaggatcacttcagcccaggagtttgaggctacagtgaactatgatcctgccactgcactccagcctgggcaacagagcaagaccctgtctccaaaaaaaaaaaaaaaaaaaaaagaaaaacaggaccattttttgcatctggtgaccatatggttttctcttaatattatgacaatttataactgttctcataaatgataatgatctataaatttttatgtttgcttttttttaatcatctcttctaggttatgagtcctaggcaattgcattaaattttataaccatagtattaaaaaaactatttatagtcaacaactcaagtttggttttcatgaaacactgggtatttttcaatgcttcccatcccatgcaggataaagtcagagtactaaatctcatattctaaactcccacacaatctgacgtctatttactggcttcttcatccattaataaaactgttccttctccacaaagtgcctttccctttataatcgtcctttaaagcccagctcaaatactaactctctatattgaaatccagttcaaattccacttcttagaaaccttcatttttccttctagtttacctcttctctttttatagcatgactttttaaaaactttcattatagtgctcaccaacctgcctttcattaattagtaactctgtattagactatatttaagtccctgaaggaaacaaactattccatagcagagtactgtgctcctaataggtagttttaaagtttttattacattaaaattaattttgtaaatttctgttatattgaagcctcttgcaatgatctgagatatgctttagatggcaaaactgaggttgctttaaatattacctttacaaaagtcacttattaccaaattgccttttagaccattttacctgtctgttggttgatgacttcatactcatatttaatgagtcagacatctctctcttttttgagacacagtctggctctgttgcccaggctggagtacagtgggacaatcatagctcactgcagccttgaattaccgggcccaagtgatcctcctacctgagccctcagcctcccaagtagctgagattacaggtgcgcaccaccatgccaggctaatttttttattttctgtagaacaaggtgtgaccatttggcccaagctggtactgaactcctgggctcatgtgatccacccaccttggcctctcaaagtgctgggattacaagccaccacacccaggccatctttaaactatttaaaactatttaaactctttaaaactattttgtccattggccaggtatggtggctgacgcctgtaatcccagcactttggaggctgaggcgggcagatcacaaggtcaacagattgagaccatcctggccaacatggtgaaaccccgtctctactaaaaatacaaaaattagctgggaatggtggcgtgcagctgtaatcccagctactcgggaggctgaggcaggagaatcgcttgaacctgggaggcggaggttgcagtgagccgagatcacaccactgcactccagcctggcaacagagcgagactccatctcaaaaacaaaaacaaccctattttgtcccttttagtttctatttatgtaacagatcctattgtcctcacaatcctcagcctgaaatccttagtcataactgccgctctcttccctccacttgccactcactccccattttatctgggttaagtccatccattatcccttatatttgctctgcaacatcttggtatgtgcccagcccactttttctgaatacactctcttctcagaagtgagctcttggtaattttctgaccagttgcttataccaggtttagggttaccagatttagcaaataaaaatatagacaattgtctgaccagttgcttatatctggcttatgggtaccagacttagcaaataaaaatataggacattcagttaaattatttgaacttcagataaacaaggaataatcttttagtgttacatgggacctacactgaacatctgtttatctgtaattccaatttaatttggcatcattattttatctggcaatctcagtcaggtttaacacctttcccaagctgagcttgtcatttcctccaaaagaacacaaacctataaaggacaggtaacgtcctgtgggacagccatcctttgccctatgctgagaaaacaggtttgcagagaataaaaacgaacaaataaataaacatttaaaaaagcagttgtgtggaaagaagcacaaaagagaggccatgagactccataattaagcagagatgaactgccctagttcttaatggcttgttagtcctcattccagtcttccacagggtgtgacttggcttccataaaataaactcacggtcccatgatcattttccctctttgctttagcaagaatctttaactaaaacaactctcttttcatttccactgtctaccactctagtctcaactctcatgagtctggaattttgcaaaagcctgataaacttgtcacatgattccagtgtctacccattccttgtaagtaaccaagatattcttgcctgattaaatgctttgaaaatatcatcttaggccaggcgcagtggctcacacctgtaagcccaacactttgggaggctgaggtgggcggatcacttgatgtcatgagttcgagaccagcctggccaatatggtgtaaccccgtctctactaaaaatacaaaacttagctgggtgtagtggcgggcgcctgtagtcccagctactcgggaggctgaggcaggagaatagcttggacccgggaggtggaggttgcagggaggtggaggttgcagggaggtggaggttgcagtgagctgagatcacgccactgtgctacagcctgggcgacacagtgagactccgtctcaaaaaaagaaaaaaaaaaaaatatcatattgtattggccatcccttgtttcatattcgttaataaactttgctactttgctttctaatttcggtgaagaacaagcacaagattaaggagtaagactatgtgaaactgggttataaattgaaaggctgttggctgttgtatcttgtaaacaattcaacgcaatgccaagtgaaaatgaagttgttagtccctctatctagaattctttcccaaatagctgcatatctttttcctctgcttcatttaagtctgtgctgaaatgttatctactcagagaagacattctggatcatttcatattaaatagtaacttttatcactctatctctttatctagttgtttttctttaaggtacctaccactacctgacatgttgtacagttaagttcttacttaatgtcttcgataggttcttgcaaactgtaactctaagataaactacataaaatgaaaccaaatttaccacaggctaattgatataaacaagagttaagatcctatggcacatttctggtaaaaaaaaaaaattaccaaacttgcaaataaagaccaaaacatttctgatgttaaacactgaagtaaatgtgagctagacaacattcaagaaagatgaataaaacaagatgatttatcaaattacaacagttcagggttttgggtggttggagcccatcctggcagttcagggtgccaggtgggaagtgatactagacaggacagccatcacattgcagggtgcactcacacacacatccacactcactcagactgggcaacaagagcaaaactctgcctcaaaacaaacaacaaacaaaataaaataaattatccagactcaggtatttcttctttcttttttgagatggagtctccctgtgtcacccaggctggagtgcagtgg

SEQ ID NO: 5827 - DNA, 2009 bp, Homo sapiens
ttcctagggtccagagttgaatatggattctttattccaagctccattcaccttgaaggatgcttttatggcatccgtgtaatctatctcttgactcatgaggttggaaaatatgtgtatagagaaagattttttagattttttatttttcttgagacagaggctcactctgttgcccaggctggagtgcagtggtgcagtcttggctcactgcaatcaccacctcccgggctcaggtaattcttgtgcctcgctggaagctttgtacacgtagattcaaacattcattcaacaaatatttattaagtatctctaccacttacaatttatgtaatgttggctctgagcaagttatttaacctctgtgcttcagtttccccatctgtaaaatggggacagtaataatacttataacagtgttcttgtgaagattaaatgaaataagacatgttaaacatgcctctaagtgttcaccaaactgtaactctatgtttatactaaaggtacaactacaacaacttaaaataccaagaaccaggcactgttctaggccttgacgttcttcctcttcttgaacttttggattctagtagataactatatgacacctgacgaatggtccttcatgaagtatgtattggtcacatcaatatctcctagctttaaatgataccctttgtctttaattgtattttctgacatgtatatgcaatcttttgcatatacagtaacattttgtttcagtagtgctgctgagtttaatctttttgacatttaagcaataattaggggtccagagttatgttaaaattaaaatatgtgtcttggctacaatgttggcaggatgaacagatacttacgttacatgattaagtatatacatgtgctagcagtgaaactaccatgtaaatcccaacttgcttgtctactagtagactttttttaaaaatgttgtttactttaaaactgtttcagagctgttaaaatatatttataaatgtacatattaagatctaggtaatatgataaaactagtatttatgggttagtcatttaaacagttgtatatatgcacattgcaaatccagtatttgtatgtgattcttataaagcaagaattctaaattagctagcatcattgttaaatgtgtcactttctcattagtttcaattattaatcataacctaatagagatttatctccatattttgattagaatgctttctttttctaatatagagacaggttagagatagagggggcttttccaagaagcgtgactcaactagcagcaacttttttgataataattacaataatgattgttacatttaattgatagtagtaatttattatttaggaaatactttcttagctatcatattgatccatcccagtcactaatgtggttcttttgggggatattagaattcacagatgttctttttctgtttgaggctattagaacgaattaataggggcttttaattatttaaaactttagaaaattaggttcatgttattttgtttgccattgctttttctctcttgaaaaataagcaggaagacctgtcctatacctcctctgtgttttccctggactccattggagggaattgttatttttatttagattttccttaaaccatcactcttttatgtgggattttctgttgacatcttttaactgcagataatttcaggtgtatatatctctgtccttagcagttcctcagcattctgctctttaatatgttgaaaagtcttccataaatcattctagctgaaatccttgccaattcaaacaatgtttatacataaactggtttaatattatacgaaaggtaaatgtaaaatcaaaactcttcattatcctccagacaaaatatggtattatgtttcatagctaactgagaaaactggctacaggatactggcactctctcttcacagctgttaattctcccacttcagtgtggacagtgtgtgctctctgttcttgctctgg

SEQ ID NO: 5828 - DNA, 2011 bp, Homo sapiens
cttctgtgacttcccaggccacggaaaaggttcagaagtagattctggtgcagttggctgtaagtggaacaggacacactggcacatccttttcccaccaaaccacagaaaaacatttttaagtgaaggttgaagaaatggcaatttacagatgccagaagaaaggataaaaatcaaggcaagataagaaaaaaggaggctgatgttctgctggtccacttggtttactggcttctctgtctgattgtgcctaactctgacactgtgccttccctctagacactgtagatgatgtttagtcctagctcaatcagtctctccctttgcacatttccgttacaaccctgctcatgtgctcaagatattgctcctgctactctcccctctcttctgcatcaacagttctttctcatctactggacaattcgcatcagcctactatcatacacaaatacccccacctttaaaaacccctcccttggtcccacactagtcttcagattccatcccattttttgctccccttgacagcaaaaacctccaaagagtatctgtactcagtgtattttctcttcacccatcagcaaaatttgacttagttaccatctcctcctggaaacagcttcttcacctggcatccaagtacctctctattctcctacctcatcaagaacttctgctttgctgattcttcatccccttgatatccaaacatagcaatgtcccaaggctcagttctcaggtccaccaagcactctcccacttcacagcccttgtatttgcagccctttctgcctgtaagctctctcaaccctcttatcctcctgaccccaggtctcttcaaatatttaccatctcagttttctttcttaatctctctatataaaaaactacatcaaaatctttttcccttatcttgctttattttttctccatagcatttagcaccagctgatatattaccatgtttatttgtttgctgtttgtcctactagaatgctagttttttgaaggcaagggctctgtctgcttggttcctgctgttggccacttcgtaacccagattctggcacataacagacccttgctacatatttgttgaatagctgaactcttagacacaatatcctaagactttgatagagatcttacttctgatagattgttctttcctgcaacaatactgattcctatataaatctggggaaggaagaaaaggtgactgatcactttttacctctcatcttttgccaaggtaaggttttttgtggttgttaaatctgaatataattaaattaaaaactttggatacccgaggcagctaactttgtttaaaaacttgctagtggtagagagagaaacttctaatctcgaaatcaaatgatctattttagaaccatgaagcaaagtcccctaaatctgtaatatgtgcattaatacaacacacatggacacacacaaacatgcaaacacaagaatgtcacctatattacacaaataataacagggaaacaagtggttgatacagatcaagcccatagagaaattgatcaagcaaactttagtctgggaaggctttttttgtggggggaaactttttgagtgtaatgaattggtaacaaaggtatgtaagatgtcttgtctgaaaactcaggaagagaaggactggaggcagagaaattctgtatgatcaaaattcacactacaggaagccaaaattaggtataatataataatggatcataactcattgaataaaatgagttgaataaaagaatcaatgagtgcactcaaatataaacaaataaatgaaggaaaaaggaaatctttcttatagtagaatacaaataataaatataaaaggagaatgatgaattagaaaaccatcaatggatgcttaatttaaggagtgaaaattttatgagaaataagatacttaaagagtctcaaagtatcactctgcagattacttgttaattacaaaaagaaaaataataacactacaggagaa

SEQ ID NO: 5829 - DNA, 11368 bp, Homo sapiens
atttcggggctgtcatcaccagaaacgccggctgccggccgcccaccagctcggctccagccagcaaggcttcccgtgagcggcccgggtgtgctctggctgctgcttccccttgtgtctgtccctgaaataaacacaactgcagcacgctgcggtaagcaaagctgcagccttgcatctggttgcagcgacgttttgaaaaaccccatccgtcagcctcgttgcagtaaagagactcaacaagaggacgcttgtctgggctttttcttccctgccttccacacgcatggtggtatctgcatttttacttttccctcccagaaatgcagtcttttcaaggggcatcggagcccgaacgtgtgcactctaaggggacagtacacactgcttagttggcttgtttttgtaatgtcacacactccacaatggatcttattctcaaacctctcatttctaagactcactaagcccagtgaagcttattttatttgtatgaaaaggataagaagcaaaagcattagattccttgctctacaatggctcttgatttcatgaattcttgatatcaggtgtcctgattttggttagctttgtttcacattatcatttagcttgaccaggggattaaataagagtattatattttaataatgacaggttatgttggaagaggtgggatttggccaactatctcataaaccacaggatccttcccaagtcccagtacattcatgattaatgttgtctaaaaaacagaaaaaagtaataaaccatgttaataagtatttaacatagcaaatgttgggctaactccccaaatcaacacacaaacaggacttcctagattaacagttcattttaaaaatggaagggaaagactacaatgtacttttattgttaggacaaagaatttttaaaattcaacactaaataaaacttctagaactatgttctgaaaggccctaagatacttcatcaatacaattagtttttcaaactcattacacttacccaaatggcaagcactcaatcactcagatttccaactccacttatacactttattctgatgaaatctctcaccagattgacttctttttaattcatgtgcatactagagttgctgaactgattttatcacttgtactttgaatgtatggattctaggtaaaataagacccaaaggttttaccttgaaacaattattatatctgaaaataaatttcatacctacgcccatctgatgcttgccaagactcagatggcagtgaatgaacaggtaggctgcacagtgccctgcgattaacgatggcatgggctctcaaggcagggccccatgttcgctcctggcaccagcccttactagctttgagccccaaagtaagctattaactttgctaagccttcgtttcctcatctgtaaaatggggttgtaccttcttcctatagttgttggaaacaataaataacactatgtatgaaaggggctcagcatagtatcttgcccatagttaacacttcattaaattttagctacattgattttttttttttttttttttttgagacaatctcactctgtcgcctgggctggaatgcagtggtgcaatcttggctcactgcaacctctgcctcccgggttcaagcgattctcctgcctcagccttctgagtagctggggtgacaggcatgcgccaccatgcccggctaatttttgtatttttagtagaaatagggtttcacagtgttggctggggtgatcttgaactcctgacctcaggtgatccacctgccttggtctcccaaagtacagacatgagccactgcgcctggcccattcattcttattatgaatccttagtgactctagaatagaacttttttttaaaaagctaaatacttttttttctttactctttatgtggtttaaaagatatattacttttgaacaccagtggtaactatttggggagagcaagttggagacatttaaaatcagttgcaataagcaaacatgctattgtatattgttactcaaatatatagagattctctctgttgactttattttaaaaaatttttaactggctttttaaagttttcaatacttaaatacataagttttcagtatttaactactataaacatactaacttgctgagaatgccactcatatatatttcaagggaaacggtcataaaaatgtaaatgctacttagaaaataatgttttcaatgccatctagctttcactgtgaagagtgaatcagcatctaagagcccagtttctgtctcttagaacctgaaatcttgtccagtgtatgctttttcttcattcgagtacctttaaagaggacatatattgtaaaagaacagaaaagggcttttgttttgttgaaaggcctgcaaatcaaatagaatgacacccgctgcaagctgagttgaaacatttatccttttgtcttctctctctctgggggggcataaaaaaattagtcagaagaggcacctggacagaggtactttaaaatgcaacagtaaaatctgaatgtgttcctggcttgctagtgacttcagttatgatttaagaggacctaaagctatctcagctttcatacctgtaaaaatgagggatccttccttaaaaatattaggagaacatacaatgaattgtcaagcatggaattaggcatagatgttggggactgagtgaaagataacaggaaaagtggaaggccttagaaaatggtatcaaagagtggggaaaaagtcggaaagtggcctgacacaagtgatgacactaaatgacaccatctacatttgttgaatataaatattgtagttaaaaaaatatatatttttatatttaatactcacctcaaacctatgaagtaagtactattattagtcccattttacagatgagaaaattgaggcttaaggaggcataaaataaggtcaaactcatatagctagtaaaatttaggtctattttagaccctgagtcacttgtcataactttgttatttatttatttttttaaaaatcacaagcaaggtgagaatcatggttaccaagttctttagagaaagctcaggaagaggctgggcacagtggctcatggctgtaatcccagcattttagaaggccaaggcgggtggatcacttgaggtcaggagttcaggaccagcctggccaacatggcgaaacgccatctctactaaaaatacaaaaattggctgggcgtggtggcacccgcctgtaatcccagctacttgggaggctgaggcaggagaatcacttgaacccaggaggcggaggttgcagtgagcctagattctgtcactgcactccagcctgggcaacagagcaagactccatctcaaaaaataaaaataaataaataaataaaagttcaggaaagatgctaaggtactccctaacacagcagaggcgcttcaggtcccactgactctcccagcctattcactgtcttcctgcctggctttgtcctgggtgatgtattccctggggactgtaaccaattccaagaaaccaagagaagaatgcctttattttttacattaatttgattcattatacaggcagtggtctctacaaggatgtctgacctagagtggagatggggtgactgaggatggaaatctagtctgaactccactctccaatttggcaggtacagaggtggcagtgggctgcttctaccctggcatgggtctgcatcagcccaggactcaatccagaggaaggggtgcctatttttttttttttatcaagataccacatgggctggtggtagctctgggtggtcaatgggaaggaggtggtcagaaggagtgacctattggtcacctatgtacctatgtcctagcaagccatgtagcagagtgggatgagggtggtaaaggatacagagactatatctcataatccatggcatttactctcctcctgtcttgatcccaattataaccatctgtcccgtctctccctccagaagacctgtgtcttactcagctttgtgttccttacatctctgtagcacacagtaagtcctcatgcaataaacatatgttgagtgaataagtgaatgagcaagcttgtcatgtctgactgttatctgctgcctgtgggaaaaaaatgtataagaaatgcaattttttgttttaattcatacttagtttactctttttttaaaagcattttgaaaatttttttgaggctaaattgtgtggcattcaaaaaaaatgtggaaacaaagccttgcaaacagtctggatgcatgccaacatcaagagccattacctaatgattttaaagcatctgattgagttgattgggttacgattggaatccacccccttttcttgtagacggatacacgtgggtacacatgtgtaattactgtcacagagtgacatgtacattcatgaacagaatgtgttaggcagaaatgtttcactagcatcctgaagaaacaaaggaaaatcactaaatgcaagaaaataattgctttatcaatttttgatcagcagtctcaacttccaaaaaagcatgaactatattatattcccactattatacattgtatcttaagaacagctccaaatcaaattaagcatcccctgaattgagatagaaagacagcagttacaatcaatggtgatgagtatggaaaaagggttttgtttttctttaaacagtagaataagaggctttttagagataacctaaaggacaaagtgttgagataaataacaaacttctcttttgacctatttttgatgcatgatttggacggatctatcccatcctaagaaatattagagaaaaaatatgaaatgatgccacacaatgtccatgtggtaagcatcaaacacaataatcattaccttaaaaaatccaacccacatatataaatcttcacaaaaatagattcagcaagttttgaaaaacatttactccattactatccactgcaaataatttttttcaatgaattgaaatacatttaaattttttgaatgcaacacaacttcattatagcaaagcttgttgttgtccagattcaaacataaacaagaaaaatcatgtcttctaaaattgttatcattgaaacatagcagcagaactcattttttctttcctactcagctcccctgcgaaggggttttataaggaacccagagccaagacaaaggaatcaggaggaattctagcacaatgggaagcccctgaagggtttaagcagaagacaataaaagactccgagaagtggcagcagggagtggaggaaaaaaagcctggaatttaccctgctttctgctctgcacatggaatgccccctccatgtgtccattgtcatccaaggtgttttgacaggtctagagtggggtaaaagaatggtatttattcaggcctaatattgaggcttggggctgggctgtatatcagagggcatgcatagacaaagctgaacaaaggggcacacctactgggcacctgctgggcacttctctaaaagtggcactgagacatcattaggatgaattagaactagggcaccagttaacccgggcctgcatgctagtgaaaggaaaattgcgcctctccctcaaccctgctccagacaactgaatggtgacttcaagaacaaatattcaggctgggtgcggtggctcacacctgtaatcccaacacttttggaggctgaggtgagtggatcacctgaggtcaggagttcgagactagcctggccaacatggtgaaaccctgtttctactaaagatacaaaaattagctgggcgtggtggtgggtgccagtaatctcagctaggaggctgaggcaggagaatcgcttgagcctgggaggcagaggttgttgagatggtgccattgcacttcagcctggacgacaagagcataactctgtctcaaaaaaaaaaaaaaaaaaaaaagaacaaatattcaaaggatattaattagaaggggagtgacattgtagaccagaccatgctccatcatataaaagctgtattgttggcaaagttgttgagcatctcatggcctcattttcctcgtctgtaaactagtgccttgtcacacaaatctgttatgaggattacatgagtgcctaggcagatgacaactgttatgtagcaaatctgtagtgagaaatgaacccagaatatgcagcacaaaatgcctccttaactccatagtcaggttagaaaaagagaagagaaggaaagaggagagagagaacctgtcatcatagagagatccctacccccaaccccctctgctggctaccaaggtaaggtagacctgcccacaaggctggaagtttcggaaaggtaaagaaagtctaaacacatgcacatacaaacactattacttaacattttagtaatattaagtcatataacatttggtgcccagggtaaacttccatttgattagaggttccggttaggttagtatcatctcaaaatttacctaatttagtcttctcatcaacctctcaaagtagtgtctgcatatttggatatcattaacctgtagtcaaaaccaggagatgttgtggttcatacatattttgtacacataaagattcgacttcaatttctgcagaataaggtcatagcacacttagtatttaatgtatttaaagacatgtatgcaaagagaaaacatgacagcatttacctcatgccccttagcatgaaagcatacaacactaatgataactttattatcctatttttgaatatcaccagcaacctgagaaattatttacgttcagatacaaacaggtcaaatataaatggccacaataggagccaactattaatacataattataaaatattaagtcccttctgaagaagcaaaaaatggcatttgcggctgggcacggtggctcacgcctgtaatcccagcactttgggaggccgaggtgggtggatcacctgaggtcaggagttcaagaccagcctgaccaacatggtgaaaccccatctctactaaaaatacaaaatttagctgggtgtggtggcgggcacctgtaatcccagctactcggaaggctgaggcgtgaaaattgcttgaacccgggaggtggaggttgtggtaggccgagatcctgccactgcactccagcctgggtgacacagcgagactccatctccaaaaaaaaaaaaaaaggcattaactttgcatattattatttaccaaaaatgcagatacataatgcttaacagtataaaaaacaattatatttatatcagtcgtcatcaccctttagattcgccatctacaggagaactaagaaaatgctggttcttccctgtatgaatgataatctagcaaaacaaaaaaatagagcattctcatagttgtattaaagttattgggtgatactcctattatttggtgataaaaattaaataccttttatggctagagtgaatattcccaccaatgttaccaatctgatacacaaaaataaatagtagggtttaagtaataagggaaagatcaacttttccttaagataccatttaatgtacataattattaaaacctataattttcaaatcaatgaaattgaggaaaactagaaattttggatagttttttagcgcatgctacttaaattttacgtttttttccttctaggtgctaaaattttttctttctaggtatgaccatgtttatagttacctattagcaaaggttgaagggctgggaatcaggaaactcatgattctgctttttattttgatcccgatcctataaccttggacatgttatttatctactaaaagaagaacactatttcccatccccaaactgcctcatctcttagggcaagccaatctttggttttctataccactgggaggaaccattgcataggaaaagcagaacactgggtaataaattattctgtgtaactctttggcaaacattatttaattttttggcaacagattcaccttcttggttatgttctaataaagctcatgtcaagagtatccatgaaaacacacactgtctactggcaggagaagctgacataggaccaaaaaataattggggattagaaagcgataaatcaatataaaaacgatcaagctgtctactgtgaaattaatgaagtagtatcaaagtgctttgttcagcttagaggaaaagcaatagaaactatataactagacaattcttgtaaaccaggaataaacaatagtcacacgccaggttattacaactgagattaaggacagtggtctaaggaattaaggatatgttacagcatcacttcatttggaactaccactttaaaaagaagtgtatacctcactgagcatcacagatttcaccttcaaagacttcaaaatgaccatctgttcatggagctgtctggtacagaccccaggtttctgccttttagaagatggtggtctaagcccgacaacagtggagcagaaaaacccatacatcacctttcctcccacagacgatgtttaaccgtacagtagtagaaaatgtgactctgaaggagcaagtatattttagaggacagagaaagtcttacaaggcgtgtttttagaaagggtgggaaatcaccaccctcctttgaccagacaggcagggctttgtgtaggagggtggggctgtcagaaactgtctgaatgatggaaggcagcagcttagcaggctagtgggaagagcgactccaactgcacggctcagcttaggaggcagaagtgaggtcaagagtaatgatctttgcagaccgtccacaggggtgagatcactctgagaagcccaaggaaacagaagtggagggtcatgattctgaccctcagtgttagctgtggagaaactcaagctcatggtcagataaaccctgctccacccagtaatggcctcagtgatccacttatgtgtttgacctatttctttctcatttataaggtacacatgattctgccctttacataaggttgtttcatgatcttaaaggagattatgtagatgaaagggctttgtattcccaggatgctaatgttagattctcagggctcccatcagtgtaagaatcagacaaataagagggtgagtggtccctgctcagcccatcgcccttaaagacacatgctggcaccttccctcattgtaatagcctgctggacttttagttttgggtttagggacatgccaggggtgtcctgctgtttaagtggccattcatcaactccaggaatgtgctggtggtttgcctgagtcttatccaaatgccactctggcctttggataaatacaggatgggtggcaactgtggtcaaattactactccaccctaccacaagccttattttccaccttctttgctcctcaagggagtttcccctttttcttatcctttaaaattatttttaaatatttatttgtctatgaattcttatatccttaccttggtatatgattttcccatatataatttatattttgtgttcattacaacaaggggtagcagaagcataagggaagggacatggacatgggccttcaccagacttctggatgaaagatgagatgactagacaattccaatagtgagaaatgtattaggaaaaaggctgaatacagaataagcacagcaatatgctctcctttggctttatatctacacttccagaggaggaaactgaaatttatcagggtaggtcccgcagcagagtaatgacagtaacagtaacagtgattactactggtcctgtgataacaacaagattggaactccgatctggtgctaagccagtgatgtccaacagaaatgcaatgcgaaccacacacgcagtgttcaatttttaagtagctacattaaaataaccaacaagcaggtgaaattaattttaataatctgttttgtttaacccaatatgccaaaaatcatttcaataattaatgaatataaaaaatattagtgagacatttaatattttttgtaccaaatagttggaatccagtgggtatttgacagcacatctgcatttggactagccacatccatcttgcagccattgtacacaatattgtacacaatagctacaagtggctaatggctcccttattggacagtgtagtctagcatgttcctaagtatttttgtgccatgagcccttttggcagtctggcgaagcccatgagttccttctcagaataatgtgtttacatgaataaaatgtggaagacacagggtgacaaagaaagcaattattttgaaacatagttattcaactatttaaaaaaacacaaaattgtggtatcgtatatacctgcttcttcaaatggtgctttaaataacattatccagaggcgtaataattataagaaattttaaataaaagaatgatcataaataatatttcaatatgcctaaagcaactgtagtgatgatgaaaatatctgtgacttcaactgatagcaaattaactttgagttgtggagttaatttggtgggtcaaaccaagacactttcctaatgacatagaataggagggaatacattagagggcatcattcacagtcaggttgagtactgtttcatgaaacctctgttatatttgtatgtatacatacacacggttaaatactgggttgcaatgtaaaatgtactttatattgcgagtcatggttttaaaaagtttgaaatcttcatactctgctagtgagaatgcaaaacggtttaactactatggaaagaatctgatggttcctcaaagagttaaacatagaattagcatacgaccctgtaatttcactgtgtacacatgccccaaagaaatgaaaacaagttatcaaacaagtatatgtacatgcatgttcatagcagcactatgcgtaatagctcaaagtcttcaatgtctatcaatggatcaatgaataaacgaaaggtggcatatatatgtaatggaatattattaatccgtaaaaaggaatgaagtttgggaacatgctacaacatggatgaacccccaaaatgttatgctaattgaagaaggctggatacaaaaaggtcacatatggtatgattctatttataagaaatatccagaataggtaaatccatagagacagaatgcagatcagctgttgccaggggctacggggagtgaagaactgggagaatctgcttaatggtgaaggggtttttactttggagtgatggaaatgtgctggaactagatagaagtggtggttgtgtaacaccacgaatgtacaaaatgtcacagaagagtcaccttaaaatggttaattatatgttgtttcactgcaat

SEQ ID NO: 5830 - DNA, 1906 bp, Homo sapiens
tattctgtcgtttgggttatactgagaaataagagttggctaaagtagaaattacatgagatttggaaggtcaaagggaaggagcaactattgctgtgaaagtctttgaaattagagacagtgaaggacagatgcagaggtacccagcaggttccagtttttcctatcttccactctatatccagcccttctttccatcttccagccctgctgaccaacagtagccccaggtctaccaccagatgcttggctgcaggctcacaaaagcttctcatggacttctccaccagcttctcatggcagtcccacatcagcagctagatgtgcctggcttctcagattttcctgaaagctctgatttatccacccatgctaatgtctcaaaagggctggtttagtgatttctttagtcttctaactcccccttctaaaccttccccagctacctctataaattgtgcatgcatcccttattccataatgctcatagttattatgcttccctgattgacatatttatactttcttttcctgagaatttggtagatgctgctcttctaaaattgagtgatgttattaagaagtcttagacaaacttgctctcttttttcttgtatataatgtgcctttctgccatatgattctttttttattcttgaagttaaggatctatggaagcatatgctttggtcctgatctttgtgtattaattttacctgagttatagtgagccattccaatcattcatttcaaggaagttttattttgcttaacattttttctgatccatttcttctcttcttcagggacatcaattatgcatatgtaagatgtctttgtcaccttctacattcatcttctaccaatcaacatccatttcacatcattattcttttcagttttgtgtgattgactctagccttgtcttcagagacaattctccttgaatctcatgttcttcatgtttagacattaacaagcaatttgctcagatttatttacattccaggatagtaaagatagagaatgtctccctccctggagactttcccagagaagatttggttgcattccaggttaataaagattatatatatatatacccaaagaagaggatggacaataaaacaatataacattatttccctcacatcttaattatgtgtattttcaatcatgtagaaatattgaaaacacagtacaacctatataacatccatctagatttaacaatttatatgtaatttttcctgaaataccagtggtaagttatagatataacattataaccataaataattgagcattcatctcctaaaaataaggacattctcccacatacctggaatatcattatcaatctaattctatgatatatccagtccatttccaaatttctcccattgtccccaaaacatattttacagttttaatgaggtagaattagcatacagaaagtggaacttgtttaaagtgtacaatttgatgagttttgacgtgtgcacctttccaaccatcatgacaatacaaataatgaacatatcaatcaccccaaaaaagtttccttatgcctctttgtcattcagccccctttccccacattcttcccacatccacaggcaatcatggatctgttttctattgttatagattagtttgcgtttcctacaattttatacacatggaataatactataggtactcttgtttggctccttccatccagcataataagtttgagattcattcatgttgttatatgcgtctatgttcattcctttttattgctaagtgttatttcattatatggacataccagaatttgtttatccattcatgttttgatggaaatttgtatttccagcttttggctattacaaataaaactgatgtgaacatttgttta

SEQ ID NO: 5831 - DNA, 556 bp, Homo sapiens
aagccaggccgcgtccgccatagtacctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgcta

SEQ ID NO: 5832 - DNA, 329 bp, Homo sapiens
acctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcat

SEQ ID NO: 5833 - DNA, 1649 bp, Homo sapiens
gaggagaagatatgaggtaattaagggtacaagaagttgagattcaaacatcctccaccttcccaccccccactgccagtgggtgataaggaaatgatcacagacgactgaagtgagctaacatgattgtggatatacccatattaattcataccggaaacacagatgagaaggttgagaaggaatagtaaagaccatgagttcggtttagattcacagagtgtggaagtccaagaggaaggtaaaaaggactgaaggcccagagtcaactgtacagtagtacaagctacggaggtggatataatcactcaagaaagatatggcaaaatggtaagtggtggggtgatggtaaaaagagacaagggtctagtgtggtggttgaaagaagcagctgaagtcagattagtcacttaaattacttgattttctgagccttcgtttcaactgcaagataaagcttacaatggcatcaacttgagatggctggtgcattaaagatataattcatataaagccattagaccaaaccctgcatgagagctcaatgaatgtcagcaattcttaccatagtgtaccattataatgttggcataaaattagattttcagaaaaaataagcttattaacatgtattagttatagaggcttattactaaaaatgcatgatgaaaaacctatgggcaagcaaaaatattttagaattctccacctcttctctcaatacccatactcttaagagttatattaaaggcagacttgtttaaatgtcaggacatttaccttagcttctttcctttagttagcctagtggctcttaaattttagtttgcttaagaataacaatagcaacacagtgtttagtacgaagtcatgcatgtatttcaactaagtagatattttaaggaattttctgcagtaattttgaaaaaacttttatcaccataactggtgattttggaattgaattacccatgtgcccatccacctcccactgcatctcccagttgcagcgggaggtgaacgggcacatgggtaaaattatatattgggtacacatatatatatgatgaaatttaacagactaaaacaaggtttaagaagagttatcttgtccaacatcatatagtcgataagaaacaggatttgaactcgggtctgccttactcaaaggcaaggtctcttttcagttttctctatgctacatctgtaggatagggagatcccaagcaggtttagtacggtgcttcactgaaggaatatcaacatttaagaagatggtggagagataatcgtagactatggtgtgcagaagccaacaaaggctgaagtaacatacaatcttcaatttctactgaaatgggaaattttgaagacactaataacccttacaaaggagggtgaaaataaaatatgaggcaaacagtaaatctcaggaatgaggtagacgaaaaaataagcgcagcatattgactaaagcacatttcttcctctatagtttgggaactgtgtcacagtcggaccaatatatggctctaaccaacatgtagcttttcttttcttttctttttttttttttttggtcttcttaatttgaggatttagcattccagttgtcatgtttgatgccattctgaaataaatctcttagg

SEQ ID NO: 5834 - DNA, 1847 bp, Homo sapiens
atctcagccttcttgcccatgtgaccttggcaagtcatttgaccgaaatgaaggtgatgcctatatcacagaattaggttattatgaagcttttcaataaatgacatcagttccttcttgtgcctctctgaaatccatatattctgcaggagaagaaggaaggttgggatgaggagctacttacagccaccccaggagacaagaaaatactattattatctggaagaagccaaagcagcagaattcaatagctacccaaggtcatccagtcaaggcagagcctagattcagacccatgtctgaatttcaagcaagtgctctttattgggccacacagatttagcacaggtcagaacccagacctctcattcttctaagttgaaaagggggagaaaagtctcatacatacaatgtctagtcctttccatttgttcctcctgcgctcccgtgcagagggcaactgtgatggtggagggaggacgtcatcttcaatggcaggatatgtctcaccgtaagcccctaagaggaccccgaaaagcagaaggagtcttaatactgcttcaaatcttacccagagctaaaccaagagccttttaattactaagattttgcttacaataccatgaaacacactcaatgtatgtacatacacagttcggtgatttttttagtaaatttacagagttgtacaatcatcactttaaagtagaacattttcatcaccttaaacagctcctttgtgcacactggcaatcactccccacctgctggccccgggcaaacacggctctgtttcaacagatttaccttacctaacaccaaacataaatggaattctacaacttaatcttttgtcttttcacttagcaataaggtgtttgagattcatctatgctgtgccatgtttaagttgtttattacattttactgctgaataatactccatcatatggatacgtcatattttgtctatgcatttaccagtagatggacatttgctagctgctagcaattatgaataacactgctatgaacattcacattcaagtttttgtgtgtggacatatcttctcatttctttgggttatagaaccagaaatgaaattgctgggtattatggttaactctactctgcattttgaggaactaccaacctgtttacattttacattgtaagagggttccaatttccccacatcctcaccaacacttggtattgtcggtctttttgcttataatcattctagtggatcggtagctaatttgacatggacaaatagcctacaacatctacggtaacctccgcaactcctttgaaaaaaattatacctaaagaaaagttagaataatacaaatacttagaatcaccattagttactttgccaatttctatatatatttggggggatgatgttattgccaagcctctttgctacaccaataagttggtgacatcatggcattttgtctctcaatatttcagtgtttatcctcataagaacaaggactggctcctacactgcaaaaatctaattataacattcagaaaatttaacatttatacaacactatcattgtttaacatataattgatattcagattttccaaatgtatactgtatgggtttttaaaaataggaataacttttattgaataagatatggggctttctataattctaaaataagttttgggtccttccatgccttttcatggtttagtagctcattttgttttagtgctgaaaaatattgcattgtctggatgtaccacactttatccattcacctactgaaagacatcttggctgcttccaagttttagcaattatgaataaaggtgctat

SEQ ID NO: 5835 - DNA, 8107 bp, Homo sapiens
aggagtttatctcgactgagtagcttccccgccactcctctaaaatccctcctcaaaaaccccaagttaaaaaaaaaaaagatctattcttgtagattttttttgtgtgggtctatgtttcattcatctgctttcaggctggatttataacaagcagaacttttaaaacggtatgattttaaaataaaattaaaaaaaaaacacgctgagatctttccatagctttggcttctgggagttgaaagcgcaggtacgtgctacatcttctggaaacctaaccctcgcacgccaagcgggaggctcttttggtcaaatactcccaggacttatgcttgagttctgaaataagtgaaagcagatgccattcctgtgcgacatagctaactgaccgcagcccagaaagttctgttggctagctgtgtgggggctgtcttaagccctgaaaacattctgcatcagaactcagcttcagaaaggggttcctgctctcctgtctgccctggagatagtcacgcatgacagcttgtgggctgactgagcatttaggcagctgcttttcctctctccctccaggaggaaaatagagcaaaaaggtagaacttacttccacacccaagtttctcctgaaagcactgtgcctgttttgtttgctacacatcttgggtatgtatgtttgcatctatgcatgcaggcatgcatgagttatttatgtgtgttatttggtccagccttgaagctccttttatttttcagtgaattgaaagaaggtaacctttggatgtatatattttagtgctccagcagattaccagtgaaacatgccgactctcaccaaaccaccccatgttgccaaatcttctctcttggccctgatgatgtgcaacttaaaaccaaggtccaggttgactgcacagcagagtttactgttcgctctctcgctctctctcctctctctttttttctgtaagcccaataaatctgccctatcacgtcattgaggccacaaggaaatgtaatcctgccaagtgtgggagttaacaaaaactgccaaagtcttaaggttgcagagagagcaagaaccactttctgggttacgcatgtctactgtgtatgtgcaggggtgccatgtgtatgtaccgcgtgtgtgtgtgggtactgtgtgtgtgcatggatgctatgtggattcaccatgcactaccatgtgtgcatgagcaccatgtgtgtacactgagagtgtatgtggctagcaggtgtgtgtactctgtgtacctgagcactgtgcgtacctgtgcactgagcctatatatgggcatgtgtttatagcatgtatgcatgtgtgctatgtgtatataccatgcacttgcacacatatactgtgtgtgcagcacaccagatgccacagatatggtggcgggagggtcaatgacagggaactggggggaggcaggtgtgaggcaggcctgcttgggaacaggtaaatcacttaaggatgcagtgcttttcatctgctttgctgctcttttcctcttaagcagcatgcgctgagattgcagaaacctgaaagatagggaaagtgtgtatcccatctccccttcctgcctgactctcaagtaagttttctttaagtatcttttttcttcagcttcaggaaaaagaggaccttagaactgaaggagcaagattccaacatcacactgtttttgttagctgtgtgtgtgtgtttcctgtgtatccaaaagacagaggagatgaaaaagcaaaagaaaagaaacgaggaatcagattggaaagaaggtttctccaggacgtcacctgtatgaggtacacagtgtgatgacacactctgtgcttttcctacttgtgtccacgtgagtgtctggagctgcccttcaaggagagcaatagatgaatgattctgccttcccgctgagagggatgtgggtcctgcggatggtcggggtgaagcttcctctcctttctgctgacagcacttcctcattaaatgcagagatctgcaaaaagggaaaataaaaacacaagaagaaaaatgaggcatcaaagaccctcctcttatgcccatggggatttggaggacgggttatttctttgctttcccaaagggcccaagaagagcttccggggagagggagagcaccctttttgaggattcccgacaagcctgtctcccgagggctcctgtaggagaggcgggctcaagcctggaagaagccttaggacgtgggggaaatgtctaacgtggagtccacctgctgagcaggaccgggtgtgaaggaagaagctttgttctgattcctcatggcccagccacccctcgcctgagctgagcctggccacagggcccgcctgcaggaagggctggcccatggcttcacactgggctcaggctgcgctaagagccccgggtgaggacctccaagcccaggaagcctcagttggccaaagtgctagatgcgtgtggtctgctttcatccccgcttccctcagagcttgcattttccaaattcaagagaggctccaccttcaagaagaccggcctgtccctgttatttatgtgtccccctaccatatctccctttgttctgcagagcggtacgcataaaaagcttttggggaaggggagaagtgtggctcagtgacttgcacaggaaattggaaattggatccccaggtctacccccactcctctgactcatgcttaaacaaacccaacacatgccctgacctttgctctctccctctattgcaggccatacctgccagcagcctgctctcccggccatgctgcggttcacaaaagtccagcatttggctagcttcctgggggaatgaatctttcagagccaaactaatgctatgcatgcagcttatgatttttttttttttgtcttcaacaaagtgaatacttactttttttttgctctttaaattgtcatccattatattcatcaacacagagagatggaacatttggcaaaattattttaagtagcactccaacctgtgatcgtaatttcaaatcaaggaatttgctgagcagctgtggggaagaacaaaaggcctgagagtgatttagggcctgggggaggggaggcggtggagttgaaggccccagccggtagcagaaacagctggggaggtaggttgtgcacaccccgtgggggagccggccttctcagccctgccatcccatccacacgtgcctcatcagagagttttcgtctcctgaacataccacatgcagcactttaaaatagataaactaagaggattcagattcagtttgataccctcgctgagagcttcggctcgggagttggacaggcctggccttgaatcctggctctgcctctcaccagcctcagttgcatcatctgtaaaatggggctaatgtagcaatcacttcgcagatattactatgaggttgagtgtttatttgacccagtcactggcatagaacaagtgttcaaaatactattattatcaccaatatgcagaaatgttcaatgtatacactcggtttttgcaaccaatttattcaatgaacatctattgagcacctgttatgtgttaggtgcagggctgggtgttgtgtgggtacaaacacataaagcataggaattaatatgctattagataaactaaaaagacttctattgacttaaaaagtaataatgacttctaagcatatttaagtaatttacgaaagagcctttcttttttttatttttgagatggagtcttgctctgtctctcaggctggagtgtaatggtgctatctcagctcactgcaacctctgcctcccgggttcaagcaattcttgtgcctcagcctccagagtagctgggtttataggcgcgtgccacgacgcccagctaatttctgtgtttttagtagaaacggggtttcaccatgttgctcaggctatcttgaactcatgacctcaggtgatccacctgcctcggcctcccaaagtgctgggattacaggtgtgagccattgcacccggtcaaaagaggctttcttaacagatggtctattagaagcaatttgaaaagaaaatatagagttgaaaaaaataaaagggaagctgcattctttttaattgtttttgaacttgttgcttttcaacacagctattatctaaattaacttaatttcttaaaataagccctgcttgatacccgggaaccttcaatcaactaatttgcagataatcagacctatttacaaatagtctggtttgtctgagtgactttcagtgacacatgcatactcagaaagggtatcatttgccagggattagtcagttctgctgaattacagtcttcagaatgagaagtcatctagttcaacctttcatccttttaatagaatttctggtggataacagctgagcttctcctccgactctgctaggaatggagaacttactacttcaaaacgtagatgctgcctgggttgagcagctctaaatgttcaagatggaatcattaataggaaactaattgaaaagaatttgcatagcacgtctcaaggacaaaaatcccttctgttgttttttccttttgtcttggtctgcatctctgtcatttggtggtgtttggactgcctgtctgtcttccctttttactccgagcggcggcctgccctctgccccctgcccccaggggaacaacaatggccctgatcacaattgggtggccaagcatatcatgccgtggaagtttggagccaacactcagttccagttgctcctctccttattctctagggtggctccactaggttctgctttctcagaaaacagcagtgaactttgttcagccgaaaccctatttcccaagctgatacttgctcactggcctcccctcctccagctgctcccaactgctgaccacttcttgagcgcactgctagctgcttctgctgttccagcacttcctggaaggcagctgcaagcagccgaggcagatggagcccaagccctgttgcttgtggtcttggcttactgagcctgaatccacgaccggatcattagaaaagggacggtgtgtgtgcctacctttgaagccagtaggccaaaagaagggtgagcaggacagcgccataacacctagagttactgtgtttggttcacacttctggtttcctgcagaattgctagaatttttaaaaaaaggaagcagcaagttgagagcaactaaagtaaaaagagaaaagtgatacaaagggaaaggtttatttttggagctcttagattctgaaactccttctgactcttttatccttttacctctccctttctcctcactgggctctttgtcctcatggggactgtgcatctctggtctcactctagctctgggtcccttaggctcttctggttttctggctcctggagtgagccctttcaatgaggccctccctcaatttcccatccctcttgttcttctgccatccagactcatcacagcccaaatctgagaccagctggctgcaccgctggctactcagagcggctggagacagccatgccctggggcgacttgttccatggtgatctgactggttcatgcaggggtctcggacctcacggacctcatcaggagcatcaaatggggttttttttggccggaatgatatttaaaacaatttgatttagttatgagcatttaagaaataggaggtcaccagaaaatccagagttttagctcggcaagcagagatggagagctggcggtacccggtctttacccattctggaaggaccactggctggagctgagaggcagtggcttctctgacatggggcatacactccattttgctaccttctctgcaacaacagagagtgtcttcctggaccccaaactgagaatcagatgcctttaatcaacgggcttgcttcctcccactccccagacaacctgattcatgagatgcctgcctgttccccgtgggcatctgagtttgcagcccatgctcagtagagtttattcggcaatccttttcctgacctatagcagactcctagcccaccacatttctaatgcagctgttgcaagtcttgtccagacctttcagacccttgatctctccgggagattgtgcctcatacattattgaaaagattgaggccacacaacatgtgctctaatgcctcagctttctgcctttctgcttctaaggtctctgttctctctccattccgtcctccttccctcctttctgactctctttttctttttttcatcacttttaaaaattgtaaaatagaatgtacgtacagaaaaaggaggccgaggcaggagaatcacttgaacctgggagacagaggttgcagtgaggcgagatcacgcattgcactccagcctgggcaataagagtgaaactctgtctcaacaaaaaagaaaaacaaaaaagaaccaaaaaaaaccccccaaaaccaaagatatacagttcagtgatttatcacaaagtcaacaccagtgtcattatcagcctgatcgagaactagaactctgccctccctcaccctggacgtactcttcattcccccgtccacctctaccctccctccctatcagaggcgaccattatcctgactttttatgtaaagcatctttgtttatctttaccacctaaatatatatataaacagatgtttatagcagttttattcataactgtaaaaacttgaaagcaaccaagatgtcctttagtaggtgaatagataataaactgggatacattcaggcaatgcaccattattcagtcctcaaaagaaatgagctatcaagccatgacatgatatggaagaactttaaatgcatattactaagtgaaagaagacagtctgaaaagactatatgctgtgtgattccaactatatgtcattgtggaaaaggcaaaactgcagaggcagtaaaaggatcagtaattggccgggcgcagtggcttacatctgtaatccaagcacttggggaggctgaggcgggcggaccatgaggtcaggagatccaggccatcctggctaacacggtgaaactccgtctctactaaaaattcaaaaaattagctaggcgtggtggcatgcgcctgtagtcccagttactcgggaggctgaggcaggagaatcgcttgaactcgagaggcggaggtttcagtgagccaagatggcgccactgcactccagcctgggcaacagagcaagactccgtctcacacacacaaaaaaagaatcagtaattgccagggattagggggagggagggatcaaacagtgcagcacagagggtttttagcacagtgaactactctgtatgatactatcatgatgggcacctgtcattaaacatttgtcaaaacttgtagaatgtacaagaccaagagagaaccctaatgtgaactatggatcctgggcgataccgatgtgccagtgtaggctcatggattgtaacaaacacacagcccaggtgggggatgttgacagtggggaaggctgtgctatgtggggggcagagggtatatgagatatctctgtaccttctgttcaattttgctgtgaacctaaaactgctctaaaaaaataaaatcttaaaaaaaaggaaaaaagtctctttaaatgctaagatttagtttttggctaaactaaactttagcatttcaatgctaaaggctgtttttttttttttaactttatataaatgtaactaaacagtgtgtattctttcatgcgccgcactttttactcaacattatacttgtgaaaatcatccaggttgtcatgtgtaggtgtagtttgcagtttttatcagtggatagtattacattaaagaaatggcataatttgtctgtctattctactcttgacggacatttaggttgtttccagtctagggctattataaatgacgcttctgtgatcatccttgctcttgtgtgctggtggaggcatatgtgtgtttctgagggtattactctgagcctggagtcttctttgtggaaaggtttaaattatcaattcagtttattgaatggttattgggttagttaagatttacatactttcttgtgtccattttt

SEQ ID NO: 5836 - DNA, 3707 bp, Homo sapiens
acacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggacaagtcctgcgcttggggatcctctgtacgcccgttcactggtgagtatgtatgacagcaatttctgatttcactagttcttgcttctaacacctaaatggtgctttgtctagggaaacgctttaaagagcattttcccccagtacgtttataatacatttcatatttacctccagaaaatactgtggatgtgataataattataaaagacaacccacagacaacaatgaaagttaagaattaagatatattctgatagatttttgcagcatattgacataaaggcagttttggttttgacatatgtacactaaaatgatatctgtaatgctattaaaactcaagtgtacaaggcaccagtatattctggcaaaaataatataatgatcaacagttaatgaaagacttgtgctttgagcttctaacaaaatgttaatatgtagagaatcttgtgattcatgatgctttggttctcaaccagggttatcaaataagctaaaagtatcagaagaggacaaagaaagtacgtaaaacatggataaaagcagaaaccgagaaaagatagctttgatatttaaagtgttagattatggcctctatataatgtcatatatgccagatccccccccaaaatcacaccctcaaattatgatcttcattattcaaaagatgtttggcgtgttggtggtacagtggtgagcgtagttgccttccagaagatggttggtgtataattactatagaatttcttgctctcttgggaggtggcttagtagaaggttgagtcaggcaagctggggctgtttattcagtgtgctgtgctgtgctgtgctgtgctgtgctgtgctgtgctgtgctgtgctgtgtctgaatgcctgggagtttgcgttgttaacctttccagggtgctagatccctttgagattatgatggaagccatgaatccttttcccacacctgtatgcaaacatgtgcctgcccatttacagacccaaagaaggacatccatgtaccccacgttaagaaggctgccctggactaagccctcactgtgactctgctgttcttaagcttcccaggaaacactgttatgtaaaaagacgagccatccaggtcaaaaagaagtcattgtggttgctaggtgggggtgcaaagccaaagacaaagggtggggaaaatacatgactaataataaataaagagcatggttaataccagagtctccaaactgatagcccagaatccctcaacatgtagccacgagtatttgtaaagtacgttgtgaattcaggtagagggccgaagactcaatattaagcagttgggcagagttttcatacatatatttgtctctgccttttgcacaatataaaactatgaaatctcttttcatttttctattgtgcacgctaccacattaggtaggaatcaaaatcatctcaactccagaagtataattcataacaattataacaaagcagaaaaatgattctacattagcagaagaaatgtagtaggaatagatttaaaatagcatggttgagtacaaaagaaacatcgttttttaaaaaatggcagcctttatcactcatcagctaaacttaaagtcaatgctgtgaggctgttgcgggaaaaaaatagtcatgattcttgggtgtattaaaaggagtatgacatagaagggtaagaaaacaagacgtagtgtgtttgtcagactcatcattgtgtcctgtttgagtcacacttaaaaaaagaatttggacaattgtgaaaagctgatacacaagcaacagaaattacacgcccttccaggaaaagataaggcaactgaggattttattccacacaaggctggaggattttttgctaatggcctttaagtagtaacagtctggtttatccttatattcctagggccttccgctctgcctggtgcacagtacttgagatgatcgttgtgtttagtgataatgagtaaggttcctgtgagagacttagcaggagtaagtaggttcaaataaaaccagcgatagtgtcatgacagacggtatataatacatgaatttgctgggtgattaatacataaggatgactgtctcacttgtgaggatgatataatacttcagcagctaactgggggaagctacaaaatctt

SEQ ID NO: 5837 - DNA, 1806 bp, Homo sapiens
taacttgtttattgcccctgtcatcagtatttgaaatcattttatttgcttgaagatttttttttcatgctcccattaagaagaaaattccttcacgacttgccgtatagcctgacacttggtaggtgctcactaaatacccgggaggtggaggttgcagtgagccgagatcacaccactgcactccagcccggtgacacagcgagactctgtgtcaaacaaaaaaaaaagaaaaaagaaaaagaaaaatacctgcaattcttggtagagataaaaggtgtcaccatctcccctccaaaacccttactcattagcagtcatttctcattcccacctttcccctccctcaagctttccccccacgccctgccaatccctaggcaaccactaatttactttttgtcgttaaggaacaaatctatactctgttgcccaggctggaatacagtggcttgctcgcagctcactgcaacctccaccttccaggttcaaatgattctcctgccctagcctcctgagtagctgatcttaaggaacattaaagcctggtacttaaaatgctctaaatgttattttgtcagatctctgtttttcaaggtgaaaacaggcttagttttctagtaattaatgtttataccaagaagcatgaaaacagatctttctctgaaacatgaattttcacaaattttgcttactagtattgtgctatgcacttacctttactaagtgcaggatgattttgtttttattttcaatttgagaccatgatgaaattagtccatatttatatcatgtttttaatgagccatggtagttgaaaattaatctatttaaagttaagtatgtgaagctggcctgattaaaatgtatcaggttgtcacagtactcagctggatatttaaaaaataatgccctcaagacaaaagcttgtggttcatgttacaacaaagatgaaaatacaggtatacttctgaagttaatccattgttagtaactaccaagtgttttttcttaaacagttttaaaataagccccatattttatgtcttatacattctctctctgtacaacagcagcattctcctacatgtagttaccacacttaagaaatttaatattgataaatattatctaataatataaactacatgtttaaatttcctaattgtgtccaaaatatctcttatagttgttttctttttaaccatttcaggatccaatcatgaatcccagactaaacatattcagcttagttgtcatgtctcctttaatctacaacagctcttgattctttttttcctactttgtgcatttctgtgtttcagtttaataatttctattcctttgtcttcacatttactgatcctttattctacaatgtctataatcttttaagcccacctagtgaacttttcatattgtatctcttttatctaggagtttcacttggatctttaaaatgtgtgtgtatgtgtgtgtgtatgtatcatccatttctctgagccttatgtttatattctccttcaaatccttgaacgtaatttataattttatgtctttatattacatgtaaatgtattcttataataataaattataatttatagctgttttaaaatccttgtctgctattcataattccgtatccatgtaatttctgggtctgtttctgttgaatggtttttctcatggttatgggtcacattttcttgcttcttggcgtgtctacctttttttttttcaactttcattttttaagttctggggtacatgtacaggatgtgcaggtttggtacataggtaaac

SEQ ID NO: 5838 - DNA, 7547 bp, Homo sapiens
actggggcgctatggtgcctggagctgggcagttttctcgtcagagtggggactggtaagagcgacctccccgccaggtcctgtgtgttgccggctgaagaagggtagctgaaaaattcagacccagcacagtgtttatgttggtcaaaaatagaaaactatgtctggcgcggccgaggcgggaggacccttcaggccaagagcagcgtagcaacatggcgcaaccccatctctgtagtcctacctcagccccccagctacttgaacccaaaggttcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctgagaaatggaatcatcgtatcgctgatctacgtaaacaaactgaagaattgtctgaaagaaaatatgacatgaacttatgaattcaacaggtgaagatttacaacttgataaatcaactttgtgagctcgagctgtaaaagccaaaggtctggtgatgatcccatacccttttttccagtctcatgttgaagatttttatgtagaaggccttcccaaaggaatttttttttttttttttttttgagatggagttttcactcttatcgcccaggctggggtgcaatggcgcaaccttgctggtcactgcaacctctgcctcctgggttcaagaaattctcctgccttagcctcccaagtcgctgggattataggtgcccaccaccacaccaggctaatttttgtatttttagtggagatggggtttcaccatgttggccgggccagtctcgaactcctgatgtcaagtgatcttcccgcctcgactcctgacatcaagtgatcttcccgcctcggcctcccagagtgctgagattacagacgtgaacccatgcctggccaggaattttgttttttaggaaggctttctactaatggaattcctggccttgagaggatgttactttcgaaggaaaggatttttttgttattaaaagagccacctaagctgaagattcccttgagaacaagtactgtcctgcggtttcatggcctttcttccatttgtggttcttgtgaagtggaatttaaatgacatcttatcaagatggataaaccctagtttcccagtgctggaatatagaaaatggatggacaagtaaatcccactcagcacccatagtccaggcatggggacctcaacacacctgagcaccagacatcacctttcattctggacctaccatgaaagacttctgaatccaggaagagaaactgactgggcaacatgttattcagagatgggacctcagtatgttgccacggctgaccttgaactcctgcactcaagggattttcctaccctggcctcccaaagtattggtattacaggcatgagccattgtgcccaccgtctctggttcttaaccttctgcctccctcttccagttttaaagaatgcttgtaattacatgggctctcctagatactccaggataatcttgttttaaggtcagctgatgagcaacattaattttatctgcactattaattcccccttcctatgtaattgtgctgtgtaacataggacatgagcaattggtggcggtgggggttattactttggccaccacagtaactattttatgccaggtactcagctaagcactggtgaattaagcatgaataacacacactccctaatctccatccattcatgggaggagcacttcacctgccatgctcctgagaatctcgggagtcagagaagtcttctatgaggaggtgatgccaaagcggacaagtgacagaggagtcaaagctagctaggaagggagtagaggtttaaggggaagcatattataagcagaggatattacccacttcagagactcccagaggagaaagagtgtgcgttcaagaggcagatgaggctcagttggactccatagcagatgaaatggagaggggcaagcagtgaggctgccttgcaaggcagggcagagcaggggctgttaaggagtttggacttaatccctgaggcaaggagaagtgatgtaaatggaggagtaacatgatgagattcatggattagagacatggctcaggctgctgtagagaaggcaccagggagagcagatggctcaatgggtgtgcaggagacctctccctgagtttagggagaggtttttaaaacagaagaagtttgagtaatttaaatgatgatgggaaggagctaaaagtgggggataggttaaagatacaggaaagcaggaggaagaactgacaagtgaggttccagagagggcaggagaagaggagattcccatagggggattaacactttcttttcttttttctttctaagacagggtctcactctgtcgcccaggctggagtgcagtggcacaatcttggctcactgtagtgtagacttcccaggctcaagggatttctcccaccccagactcccaagtagctggaactatgggtgtgcaccaccaccacacctggctaatgtctcttttttttggtagacacagagtctcactatttagcactgattggtctccaactcctggcctcaagcgatcctcctgcctaggcttcccaaattgctgggattacaggcatgagccacaatgcctggcctctgctagttccgtattctctagagttgtctttactttgtgctagtgtgtccctcattgtgctgatcctctgtaaaaattaatacctttttttttttttttttttttgagatggagtttcactcttgttgcccaggctggagtgcaatggcactatctcggctcagcgcaacctccacctgccgggttcaagcgattctcctgcctcagcctcccgagtagttgggattacaggcatgtgccaccatgcccagctgattttgtatatttagtagagatggggtttctctatgctggtcaggctggtctcgaactcctgacctcaggtgatctgtctgccttggcctcccaaagtgctgggattacaggcatgagccattttgcctggccaaaattaatactttttatattaaatttacatatatatatatatatatatgttttttctttttgataccgggtctcacactgtcacccaggctggagtacagtggcacaacctctgctcactgcagcctccacctgccaggctcaagcaatgctcctgcctcagcctcccgagtagctgggattacaggtaagtgccaccacacccagctgatttttgtgttttttgtagagacgaggtttcgccatgtttcccagactgttctcaaactcctgagctcaaagcagtccacccaccttggcctcccagagtgctgggattacaggtgtgagccatcttgctcattctagtttaaacttttgagtagtttgtgtctcctgattggactcctacaaatacagaattgatgctaggaagggtaccaggagatagacgcacacagatgggatttgggaataggtttggttatccaaggagcagtgctgagctccttgctaatgggatatgggatgctggtgatttccaggaagtgagctcacaatgactcaagctgccacatagtgttgattgtgaaatgccagttgaagcatatgtcctgcgagcttgggggtgctacaagttgaccactgcagcagtaaagatgactctgaagaatggcgtgggatggatcctttcaaatgcacttgagcagcagtctccaaccacagggccacagagctggagctggatctaccatgaaagacttctgaatccaggaagagagactgactgggcaacatgttattcagggtctccctctgttgtccaaggctggagtgtagtagtgctatcacagctgactgcagcctcaaccttctaggctgaagcgatcctcccatctcaacctcccacgtggctgagactacaggtgcttgccactatgcccaactaatatttggaattttcgtatacgtggattccagaggggtgacagcgaaatgtgagtaagcatggattttggtatatgcagagatggggggctggaactaattctgtatactgaggaacgactgtatatgtttttacaattacgctgtaggatacatactgttgcatagccttgaaaataataatttttaattgagtggaataataataatattgataaaagtagcagctggccaggtgtggtggctcacactggtaatcgcaacactttgggaggctgaggcaggaggatggcttgaggtcaagagtttgcgataggccttggaaacaaagggagtcaccatccctacagaaaaatacatgaattagcctagtgtggtggcatgttcctgtagtcccagctacttgggaggctgaggtgggaggatcacttgagcccagggaggctgagactgcagtgagtcatgatcaggcctctgcactccagcctgggtgacagagtgagaccctgtctcaaaacaacaaaaaagtagcagctaacatcaactgaccttttaccaggtgcctattgataccatagtttaatttcttataactgtttcttatttcacttaccaactctgtcttcagttactcccagatttttactgtgtgtgtacagatgaccttttgtttagattgaattgtctccccagaagtaagattactgtgagtcatggtgaatggacattctcattacccttgatgtaaattgacagggttttgggtgcctcctagctataatcttagcactttgggaggctaagagaggaggattgcttgaggccaagagttggaggaggcagtatggcagtatggtgagaccctgtctctattattttaaaaaattgacaggctttaccctggaaggcttatacacaatttaaacacccctcatagtataaaaaagtgcccatttcactgcacctttgccagcacagggtattataatttagtaagtcattttttgtttgattattttacatagacaaaagaactcatattactttacttgtcacatttcaacatctttcctcagcttattagctctatttcttttctgtctgtaaatggttattgttgttttgttctttgagacagggtcttgctctgtcaccaggctggactgtagtggcataatcatgcctcactgcagccttgacctcccaggctcaaacttccgcattccgaatagctgggactacaagtgtgcaccaccacccccagctaacttttttcttcttttggatagagacagggtctcactgtgttgtccagaccggtctctagctcctggccttaagcaatcctcctgcattagcttctcaaattgctggaatttcaggcatgagccaccgtgcctggcctgggctagtcctatattctctagagttctctttactttgtgctagtcaatctctcattatgctgttcacctgttataatgaataattctctgtattaaattttaccactttaaacttttgagtggtttatgcttcctgattggactctgactaatatgttaggaagggtcccaggagataaacccacacagatgggatttgggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcacttgaccactgtgaagactggtgtgggaagaagggtcgtttctgatgcacttgagcaggggtccccaacccctgagccatggagccgcaaggagccacacagcaggagctcctacctcccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccaactcctgcatcttggtggcccctccaggcccagcctgtgcctcccgtcggcctctacaatcccaacatctgcctcacagcagattcttcacgcccagcctctgcctcacagtggaccctccagacccagatggtgtctcactgtggcatcctcaggcgaagctcctgcctttcagcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttccggcagcctcttggcttctaatttgtttatcttttgtgtataaatcccaaaatatggaattttggaatatttccaccattatatattttggtcggtaatttatttggagtgagtttctgcaccatgcccgaattttttattttattttccttattatttggtgttaaacaggtttaatgacagtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttctgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgatgtcaggagatcgaaatcagcctggccaagatgatgaagccccgtctgtactaaaaatacaaaaattagccggacgtggtagtgtgcacctgtaatcctagctacccggaaggctgaggcaggagaatggcgtga

SEQ ID NO: 5839 - DNA, 2393 bp, Homo sapiens
ttttttttttaacaggaataaaacagtgaaaattacaaactgtaaaaaggaagacaaatcttgtctccaacttttcagagaagcaagatttaacacagcacattgaagatcaatacatatttgaatttaagaacaagaatttaatattacaatattatacactactttacaaaattaaaatttctatataaggattacatttgtaatagttaacaaaattttgaaatcacatttggtggtcccctagataatagctgttatgcatctttgattagaagaaataaatctttattctaattattgcaaaacagtctattagactcaatacattaaattaaaaacagtgaaaatatatgcaaactaaaataaatggtactgcttgagtgactattagtatgtcagacttacagaaatgttattttaaaaatcctagaaattagaaaaatagagtactttttatggtagaactgccatgctcagatttaaataccaagattgcccttgtctgttacattagtagttgtagatctgtagaaaattcaaggatctttcataatttacaactataattaaaaaaaatatggcatagtgtaaatattagtcgctttacatcaaaaagtaatacaagatgatatggcaggtagtgccctattgggggaaaaaaaaagaatcaaactaaaaaacacattcaacattgcaaaaaataattgccttatatcagtatctccaaaggctcattcattctctcattatgtggagaacaaatattgtgaatcctaactaaagttatgtttttcatgacctgttataaaattattctgaattgcacatgttacaccgtatctaaaataatatttaaaagtaaatttgtgaaatatactaaaaaagcatgtggtaataacaagagtcatacccacttagggatgtagtgaggcacaaggaagattatccctaaaagcacaaatgtttccctctagaagattctttactactaagaaaggacctacaaataactccatttaaaatcacattaagaggaacattttagttattttaagaaacatcagcatataacgactgtttctttaaaagaggggataatataattcgctacaatttgaaaattgcttcttaatagatgaagcagctttcaagaaaacttccagttcaatgtgccacttacacactgcaaaccaaccttaacactgcttaagggagatattttcataaaacatgattattttgatccagctggcaagcagtagttgtatactgtagagggactgcttcttccctatcccaaacaactcagttaaagtcagctcatattgatataaacctggaagttactattccattggtgatcatataagaccaagattgtaaacattttctaacccattaaaacaaaacaaaaaacccaaaaatattttgatcaagtattatacatgaacatatttaagaaattcttaagacaaaatgaatctgtgaaaactgagccaaactcttaaagatactatgtcacagcactttaaatatacaaatgtataatttacctatttgtaaacaaaattcactcaatagttttgactataatatttctctagctgaatcaagaaagcagtctcttaaggattttcagaagtcaagtttctttcataactttaatatgttggatgtgtataatcttaatatccaccaaatcaaacagcagcatttatgctttcatagattttcatattcaagcataaatatttcttatgaatgacttccaatttaacaattaaactccttagaaaaatgttactgatgtatttggatagcactttagaaacctttcatttcttcactcatttcaccaaaaacccccacttttattatatacccagagcagaaatgcaccaaataaaatccacttaaaggatcaagataattaaagtttcttatctccctattatcattgctagtcccagtgtttatgaagacagctcaaattcttttcactatagattaagacagtatgtccaactcttcatcaggaaatcagaaaaccacctaatgatagttctcacttcaaatcaaagtgactttgttcttcaagcataaagaatactgacagattttaaagcttgaatgtgtttcttcatatttttctcaagctatactagaattagtttagttttagtcaacatgatcctttcccttaacaaagaaaaaaaaaagacacgtgtggggaatgaattctagttttcctacattatatttactttccattgtttttattttaaaaacatcactaccaatcaatttgtaacttccctgcaacacttaggtttgtgaggttttaaatgtagcagccaaagattcagaaaaattaaaaatgagaaatatac

SEQ ID NO: 5840 - DNA, 13143 bp, Homo sapiens
gacgcagccgggacggtagctgcggtgcggaccggaggagccatcttgtctcgtcgccggggagtcaggcccctaaatcgaagaagccctggcgcgccctccccccctcccgggtctgggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacatatcaagatgcatttattaggaaggaggagtttagagagcaggctatcagaataaccactcatcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatggtaaatccctctgtttataatgcactttacagtttcaaagcacttgtacgtacatttatctcaattatcaaaataacagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattgggaacctcaggaaattttccagcttcctgatctggtgcccctagtcacataggatgtgtgatcacgtgatagctacatctggaccagaatcccatggcaatatcccacggtttaagggcataatatctccgtggtggtagattgtcaagtcaaaaacgggacatgttctaacagcaaagctacccaatatgaaacacaaagctacttttagattttttaagacttactgatattcctgggccctaagagcttgtctatggtcctatctttgcaaactagtatttacacaaaatgagccacctggtttttttaaagtcagtattgtgtgtgtgtgtgtaaatatgacatggagaaagcttctgttacctagtaagatagtaaagtatgtaagacatggcccttcccccagtctacattgaggtatagtgtattaaaggatctcaggagacttgcagcaaattactactgcttctgtgcttaaattcagaagtctgaaaaaaaaaaaaaaagacttctagtaaagagttccattttgctgtttaaccctttgtgtcctaagtttaatcaaacacagaaggatatttttttgcatcattccatctaatggaatgcagaaactgctctagagcagtataaccagtgcttcctgattgccagcagattgccctggacaccccagaataaacagcatcttcaaaatccccctttctcataccttcttattaatggttgaattagtatgtctctgtcatctgagagtcttgcatcttgaccattacctttattttctgtcaagggaatccctagaagatgtatggggagacataggaaaggaatggaagaaagttaattcaccccaaattggataaattccatgacatttagcaatatacttctgtatccctagaattgtatcataactttagttcaaggacattgcatctcaggtgggttaaggaggttgggaaggggagaaaagggatgaggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgatttaaaatgcctacttttatgttagtaaatattaaatataaatcattcattactcaagttgacagattgctataccattgcttgtttgagaaactcagagcttagtaattgttccttagttttttaagcatgtctccttcaagtgagtttatttggattatcagaattttgtggttttaaggtttatcaaagattattctagttcttgactgatgttgatctgctaagactattgcagtatccacattaggcagaaagcagggggaaagtcactttttttaaaaaatccttgaaatattctgatgtcactgcaattaaggtcaatagtgaccttttcattgctaaatccgttacacctgcatctaatatgaactttcagcagcacaggtaactcccaccagcttcttgaaacacttcccttaagtgctataatacttttaattttcttttcaacttgcagactactcctttattgtaggttcttctccccatcatgtaaatataggtatagtggacatccattgctttggcttgccaaaaatcacttcccctttactttaatcatacatccccacttatcctttagaaagctgctccttcccattctgtgtggtggtagtggaaatgtagatgacagtactccggcctcatgccccctggctgaggtttgagcaatgcaagctcgttctgtcccacaaggactttgattcttaagaaaggtgaccacaaagtgatcagagttgagtcattctgatcgtagtgttctaaagaaaccatttaaaagtttatgaaaggagatctccaaagtatgctggctcctattctccaagcctggttgtccaagttttcctttgattgtataaactaccacatagcctccttaaaataagtttcctttttgtcagccaaaatgggtttctattgctggtgaccaaatgactgactaattacagaaatggaggccggagagttaaatggtaggcctttaacccacaggaacatatggaggatctggaattgattattgtactgagacagataatggcaccagctcttgttctgtgtccctgggaggataaatctacgagttaagggtgacaaaacagtaatgatatcatttcttgtcatttggaatcgtgcctgttgagagtagaatttggagggccaggtaattgttgacaataggacaatttaaagtggatagactgggcacagtggctcacacctgtaatcccagcactttgggagaccaaggtgggtggagcaccttaggtcaaggaattcaagaccagcctggccacatgatgaaaccccgtctctacaaaaatacaaaaattagccaggcatgatggttaatcatgtaatcccagctactcgggaggctgaggctggagaatgacttgaacccaggaggcagaggttgtggtgagccaagatcgcactgttgcactctagcctgggcaacagagcaagactccatctcaaaaaaaaagaaagaaaaaattagctgagcatggtgttgggtacctgtaatcccagctacttgggaggctgaggcaggagaatctcttgaacctgggaagcagtgtttgcagtgagctgagattgtgccactgcactccagcctaggtgacagagtgagattctgtctcaaaaaaataaagtggataaagcaggccaggaccactgagttagaatggttactttgattgcattagctattttattttttttaattttatttatatatatatatatactttgagacagagtctcgctgcaacgcccaggctggagtgcaatggtgcgatctcagctcactgcaacctctgcctcctgggttcaagtggttctcctgcctcagcctcccaagtagctgggattacaggcacacgcgatcatgctgaactcatttttgtatttttagtagagatgttggccagggtggttttgaactcctgacctcaagtgatccgcccacctcagcctcccaaagtgccgggattacaggcatgagctaccgcccctggccccggtagctgtcttaaagtgaagggcatcagctcaaacccagaaactgacctgtgggcatagaataaaatacaggccctttttgtggccaggataaatgaatctcggtgcttaaatccacactagtacttggagattaattattcaaattgcaaaattacaatgctggttgaatttgtagcattactaacgtctcttttgtgagagttaaggtattaatcagaaaagagactgtatagagtgctgatacctgggaagattcagaagatttagagaatcccaatcctcgaaatatctcaggaatgaaggtttgggttaccctattagtcaaaaatccctgactgaattaaacaaaaaagtatagtcaaagaggaagagataaatagcagttatagccccataacctgttggagaagtaagatctgtagcctctaccccatatcttttaggttgccttattttatttccccctctcctctttattcattacagtattctgccctaacatttcctggctgaagtttgagcatgatgcaagttaatccaatcagatttctcctccattggagctgagccattctagtggtagtgtcccctcactgatgtgtatgagtgtgttggtgatggttaaatatatcaggaaatccgtaagttgcagattatcaagatggggttaagaactagagaagaatgagcatcacccagaaatcttaggcttataactagaaattattttaggttatctccctttaagaggaagatctccctttaggggggattatgttgagtgaaggtattaagattgttcatgttgaagaatgcatgtccacatagtgtacgtttgcctacccagtgttatctttttcccctctgagaatagcacttcacctttcctttgggaaactacccatttcccatgccatgtgagcccagaggataatgtgtaagaggtatatgagtttctgagaggaatgtgagaggtcttcacctgcccagattcctgacttaatctttaagtcttcttgccctgtagactctgaaaaatctcatccatttccatggccttggtttctaactgtatattgataatttccagattcctacctttggccttgatatgtgtcttgagctccagatctgaatgcccacctgtaccttgatatccactgcttgattaacacaaagatactctcacccaacataataaacgctgacctcttcattttttccttaaaatctgctctccagtgttccctttgttggtaaatggcaccaccctctactctgtttctcaaaccagaacatgagagttattctcgaagcttccctctctcccagagtccctgttagtcattaaatgatcttggtgttagcatgtaaatatataccttaaaactatctccacttctatcactttgtccaagggaacatatatctgttgctgtaagtactataatgcctttctagtggtttcactgcctctattattgtcccactgcagtcttctctacaggacagctagagtagccccccaagagatagggtatccctgttgcccaggctggaatgcagtgtcaatcatagtttactgcagcctcaaactcttggcctcaagcatccctcctgcctcagcctcatgagtagctgggactgcaggcacgtaccaccatgcctggctggccatttatttatttatttattttgtagatacactatctcgctatgttgcccaggctggtcttgaactcctggcttcaagcaatcctcccactttggcctcccaaaccactaggattacaggtgtgagccactatgcccagcctacttaaccttttaatagttcccccggcatttcagaataaaatctaaactctcctggtttacaaggctcttcagcttctcattatcttattcctcaagcttcatcttttgccacttcaaacaggaacaactcaattttgtatattggaatttcctgtattattattatttcatttgaaaaaaaagtttccacttttttttttttttttttttgaactgaagtcttgctctgttgccagacaggagtgcaatggcactacctcggctcactgcaatctttgcctcccaggttcaagcaattctcctgcctcagcctcccgagtagctgggactacaactgcgtaccaccatgcccagctaattttttgtatcttagtagaaacggggtttcaccatgttgaccagaatggtctcaatctcctgacctcgtgatccatccccctcggcctcccaaagtgctgggattacaggtgtgagccacagtgcctggctgggttccacattttttaaagcagtggagatgcaagaattcattaaaagaaagacaaaattgaaatgattattcagaacaacccaaaagcctattgctatgaatactgtaatttattttcttccatatttctttccatgaaatttttaaaaatctagtatttgtaactgatacagagagctacagtaaggtgcctagagagcaaccaaatccctacctcacaacatttacaaagataaataccaaaaggactacagatttaaatcttaaaatgaaacactagaagaatatttaggagactatttttgtgatcttatgacatgggagattttcataaacaaagcagaaaacctacaagccataaaggaaattacagacatataagactacatgaaacaaatcttggttctgtaaaagatgtgatagattggagagatatttccaacataaatgacagatccaggactaatgttgctaatacagagagttcctacaaatttataagtaaagtaataatcactagccatttatttggtgtttgtttcatacttggcattgtttcaggcactttacaagtgttatttaattgtcacagtttatgagataggcaatattattcctgttttacagctacggaaacaggctcagaaggataaaataacttgcccatgtcacacaataggtgatagagctatgactcaaacacaggttgtctgttagtctgtactttgaaccatgatgctcttcaacatttccgtaagcatatgaaagataatgaggtcagtgagatgtgatgtacaacagagcaatgaagtaccatttgccacctatcagatggcagaatttaaaagagcagtaacatatagtgctggcaagaattagggtaacaaaacttttatacattgttggtgggcatgtagattgttccaatttttttagatgatgatctggcaatactgatgcaaatttttaaatatacacttttggacccagcattcctactttaaagactctcaaagaactaaaagcaccaagataaaaggacatcagtatgagaaatttactgcaacgtaacctgtgctagcaaaaaaatttaaaaagcaatcgatcaaagtggagtggttgaatcagttataggacagctatactgtggagtgttatgcaactgttagaaagaagacctctatttcttagcctgtggcatgtccatgatgcattaagcaaaacaaacaaaaattacagagtaatgtatatcataatagcccattgtatggggtgcagggctggaagccctacaaatgtatctaaatgaacatgaaagaaaagtggaaggatacaccaaattgaggggtttggagaaacttggtgctttatacatactggcattgtttcactggttgtgggagcacatcctttttttttttttt

SEQ ID NO: 5841 - DNA, 406 bp, Homo sapiens
actccaaattaatatagtgtttatagccacttacataataatgagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaa

SEQ ID NO: 5842 - DNA, 3673 bp, Homo sapiens
tactcaatccaaatatgcctttaaaaagtcgtaaaaaaatactgccatgttgctctccaaaaagattgcatccatttgtactcccagcaacagtgtataagagagcctactgtcttacaccaactggggggatgatttcctaagtaggatgactaggaaaatacaggtcataaccccacttaggcaactctcaggagctgtgcccacacttccataacagtgccagtatatggtagacactcaacagtcacccattgtcaactcatctgctcagcccatgacgtgggaaaaactcatccaaataactggattatctgctgtgattccaacacattttattgtgcagagaataataatgatattgatgatgatggcgacaattcttaagcccttactgtgtgtcatatgcaaaattaagtgcttttcaagtattatctcacttactcttcttaacactcctgtgaagcaagttttattattttctagaagaaaaccaaggctcagagaagcaaagttatcttcccaagaatatcaagatgataagtggcagactgacaatgtgaacccaggtcagtgacatggtttggatatttgtcccctccaaatctcatgttgaaatgttttctccagtgttataggtggggcctagcaggaggtgtttgggtcatgagagcggatccctcatgaatggcttaggtgccctccccttggtgataagtgagttctcaattaattcacatgagagctagttgtttaaaagagcctggtgcctcttcccccatctcttgcttccttctctcatcatgtgatacaccggctccccatcacctttctgccacggttataagcttcctgaagcctcaccaggagcagatgctggtactgtgtttcatatacagcctgcaggactgtaagccaaataataaaccttgtttttttaaataaataaattacccagtctcaggtattccgttgtaacaatgcaaaatgaactaatacagaaaattggtgctaaggagtagaatgttgctatgaagatacctgaaggtgtggaagcagctctggaactgggtaatgagcagaggttggaagagtttggagggctcagggctcaaaagatgacaaaaagacaagggaaggtttggaccttctttgagactagttaaatggtaataactaaaatactgatagaaatagggacagcaaaggccaggctgaggtggtctcaagtggaaatgaggcagttattgggaactggaataaaaatcaccctttttatgccttagcaaataatttgtctgtattgtgtccatgcccgggggatttgtgggaggttgaacttaagagtgatgacttagagtatctggtaaaataaatttctagggcgggcacagtagctcacacttgtaatcccagcactttggaaggccaaggcgggtggatcacaaggtcaggagtttgagaccagcctagccaatatggtgaaaccccatctctactaaaaatacaaaaattagactggcatggtggcaggcgcctgtaatcccagctacttgggaggctgaggcaggagaatagcttgaacccaggaggtggaggttgtagtgagctgagattgtgccactgcactctagcctgggtgacagagtgagactctgtctcgaaaaaaaaaaaaattataagaaacaaagcattcaagatgtggcatggctgcttcgaacagcctaagatcaggaataggtgtaaaggaatgacttaaagttggaacttataattaaaaggaaaacagagcataaaaatttggaaaatttgcagcctggccatgcagtgaagaaggaaaaggcatttgcaggagagaaatataagagagctgtggaacaatcacttcctagagagatttgcatgactaaaagggaaacaggtgctgatagccaagaccagagtttaaaaaaggcattgaagtcatttcagaaacctctgggacagtccctcccattacaggcccagaagcctaaaggaaataatggttttggaggccacgctcaggggatgcctagtgctacctcaggacactgctgcccacatcccagtttctctggctccagcagtggctcaaagtgccccaggtaccattccagctgttactctggagggagcaagctataagccttggtggcttccacatagtgctaagtctacaggtgcacagagtacaagagaaggaggctttgcagcttccacctagatttcagaagatgtatagaaaagcctgggtgcccaagcagaagcctaccacaggggtggagcccccacaaagagactctaccagggcagtgccaaggggatatgtggggttggagcccctgacacttcctagtggagccgtgggaagggggttcttgccctctagacccaagaagggtagagccaccggcttgcaccctgagcctggaaaaaccacaggcactcaactccaatctgtgagagcagacccaggggctggaacccttcaaagccacaggggcagagctgcccagggccttgggagcccatcctttgcatcagtatgtcctggatgtggaacatggggtcaaagactattttggagctttaagatttaatgtctgctctgctgtgtttcagactcaagtggggcctgctgtccctttcttttggccaaattctcccttttggaatgggaatgtgtacccaatgcctgtgccaccattgtatcttataagtaaataacttattcttgattttacaagctcgtaggtgcaaggaacttgccttgagtctcagatgagactttgaacttctgattgagttgatgctggaataaattaagactttaggggactattgggcaggaatgattgtattttgcgatgtgagaaggacatgagatttggagtaccaggggcagaaaatatggcttagatatttgtcccctccaaacgtcgtgttgaaatgtgatctccaatgttggaggtggggcctagtagaaggtagagtcatagggacagatccctcatgaacagcttggtgccctccccttggtaatgagtgagctctcactctttagtgagttttcactctattagttctcactctattagtatgagagagctagttgtttcaaaaagtctgccacctcctccctgtctcttgcttcctcttgccatgtgatacactggctcccctgttgccttctgccatgagtgaaggcttgctgtggcctcacctggggcagatgctggcaactacacttcttgttcagcctacagaaccatgagccaaacaagcctcttttctctataaattacccagtctcgggtattcctttatagcaacacaaacagactaacacagtcagtcatgagctaactctgcagctcatgctttgaaccactttgttcctctttggcgctgctccccctccctcatttcttccccagattattctgttgccatcatttcttcatatgaaatacctgtagtcatttgggtctagactgggcatgggtagttatagcactcacctggagaacatgatggattttgcctttgggacttctaagcccatggttaaacattacactctcagaagaaaaggcctggatttataagtgaccagcagggcatactgaatcagtacctagtacctcctgtg

SEQ ID NO: 5843 - DNA, 2901 bp, Homo sapiens
acccatgggggccccaatgtctacagttctcagctccctaacttcttggacttgttggcacttcttattgagactctttctcagacaaagggaaaaaagcacttaactctaccttcacatctcgatgcatgatgcccaagtcatggagataacacagtaccagcaccaactcggcagcaaagagacggatggaagcctcaggaaagcagccaacagccgaccaaagggagtacagatctgtgctgcagtagctacacactgcaaagccagtgtggagctacatacattgccagaagtctaggcaatgtttgggagctgcaatgcctgggctcaaggcattgtaggcctcctgcccaaactgataccacctgctgttcccctccctttgggacagagaggtgccatgagaagggggacagagcaaaggcagaacaagccaaagaggtaatctcaggtggggaacatggtacaaagaccctgggggatgaggagagagtccagtcactcactaatgaaaaggtgccgttttccctgccagctgtcccccaagctgtgtacaaagggatggttgatctgtcgctggatgctaacctcctctttgcactgcctcacggtatccctctgtaggacctttaccttgggcaccaccttcactgcaaatacagctttctgggtgcaatctagcaccttgaggacagttccaaaggagcctttagccacgaggcctaaaatcttcagctgctgctgccccctaatgggcctaatgggaaactctggtagaaagaggttgatgaactgaggcactggccactctggcagaggcttctctaccagtactggggctggctttagggattcctggtgcagatagtggtgcccccgtagttcccagagttcttccagatctgacctgatggttcccaaacctgtccagaggctcttccagcctcgggcccagggaccccggatgttgccaccctgcttgtgagggacagccacccgggtgtgttccccctgctgggtgtgctgcccctgccgacagcttactgctcccattcccagcctctgcctcctctctctgctaaatctgctgtcccagttatataagcaattcctctccctgatgctgcgtgacacgagccccgcctcttccagtctgcagaaacccatcagcatggggccagagtcacactaggactagaaatttctgtgatacagcttcagggcagaggaaggaaggggccaccctcagagtggcagctgcaggatgttctgggttgatgagggaggaatacacagattgaatgcatgcactcaacacacacacacaaaaatgagcatcaaatttaaaatatctttttttttctctttaaatcattttgccattctccagggtatatcctacggggaagggtaggggacccatggccagccctggctcctactgccatcctcccaagtgaacttagcacagagactggggaggggttgacccccactccagaacaccaatacctctttcaaacatgacagtggagtgaggatcagaggatcagccccctcccgtttcctggcacagaggaaggacagttacacttagaaatatatatataatatatatatatttatatatgtctataaaaatttatcacacttgatcaggactatccccctaccctttcacttgaccccaagggaatagggtcctgccctgggcccattccctgggtcttgctctcttgttgcctctctggccctgagcctgatcagtgtgagacagaactcagcattactgtccaccatgccctgcagcgaacagaccaggtgctgaagagtgatgcctatgggctctgacacccacaaatcctcgtggataacgggaagcccctcccaccccacaagtccctggagcctgagccagagtcagatcctgtactgcagccactcgaatcgccaaatcatttgcgcctgccaaagatggacttcttgccagggttcttgtcgcccacacttaaaccaatgaggagccgggctttctcctcctcttcctgctgttgcatgttcaggtccgatttagtttctagctttccccggacctcagagcctgttgcagacttcagccttagcttctctttgattacctgggcaaccagggctttgcggctgtcccttttgacagccatggcaaagtctagccatgtccatgtgttgttgtggtactccagacagggcagcaccaggttaaggtcaccccagtccacactgttcttctcacccttgtagctgacacacagtggaacctgtggaatctttatgtagatgaaggagttgttcatggcagctcgctctttcatcttgtcaatgtcatccacagggtgctctggcgatttgcgaaatgaccttctgaccccagaactccgagtcaaaccctgtgccacacccttcccagggcccagtggtactgcatcatctgttgcaatcagctgccgaggcttcaccactggtattccagtagtcaccagtttggacttatcctcttcatcaccaacttcatcatcttccacacttcggccaggaaagaaaaagcccatcattctgtggaagaactggtgtgtcagctggatggtgagaggcaccacatttacctcaaaatgctccttaacagagatacccccaacagggggccgaactttgctgaagaggcggagagctagctgtcgcccagactggcaggagctctggggccgcagtactaccttatagacagcattggggaggaggttgttcatggtaaaccagcccaactccagaagatgttctgctgtgtcatcagacttattcacctataaagacagattttgccccatctactataataaacctttctcagaagtctactag

SEQ ID NO: 5844 - DNA, 905 bp, Homo sapiens
agttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagtttcagagtgctggccacaccaaagcatcagccctggctctaaactccgttacagtaaggaattacaaatcctgtgtttgtactccaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatt

SEQ ID NO: 5845 - DNA, 9596 bp, Homo sapiens
acacggaagcaactgcaaggactaagggagtccgcagcctggggcattggagcccttcgccatacccctagtgcgtcctcaccccctcagcccgtgcttcccagggcgggtatcctcggaaggcccggccctcacagccttggcaggccaaggtcagaatgattggagttgggggatgggacgggggcatccctccaggaccagctctccaggaggcccacattctttctgcgggaaccactccaaaggggcatgctgttccaggcagcccctcgcgcagacactccggctttgtcgaggtaggagtacgcttactctggaattctgccttgctagtgactgacacaggctgttaaagtgcttgaccctgcaggggtgggtggggggttccttggaaaaggtaagggcgctgtggaaaagaggcccctacataaatcctaatctctttgggattttgcccctgctcgtgcaactttggggatcgaacgggatgggggtgggcagctctgaggctttttacgggttcagcctttcccattttcccccatcgaaggacccaataggatgcataggacatttctatgggcagcctgggaccatccctgacacagcaaccacccccgctcctccccaccataggatatttctacttctttgacagagtaacctaaacccctgggggggctgggagccacagattcctgtcattccaaagtgggggtgggggcatggctaaaaaaaacgtgaccacgctgttcctggtgtgtaggtatggatttagaaatcggtccactcagaacgcaggggctttcaaaagtttcctctaggaagcatctgtcagtataccctcttaatgtttgacagttctaatcacaattatatttagaatttgagaaacccccctgtgtgtctaatggctgccagcgtgatgccagagaaccctggcaggtggcctgcagtaagcagaaggcccacaccttctgcagagccaggagcagtgcccgagtcccccggtctgtgtctatcctttcacccacatggtcactgtggagatgaccatctgaccagacttcggagcccccaggcagaagaaaggctgcagggggcctgggaaggtggcctgggagtaggtgtgcaggtgggacccatcgcttacactgtagaaggacacttccccggcttcgaagtccaggaagatgcccatgtggctgggaggctccatcagcatgaccggggttagggcagagaaggtggataagtacttggtccccttggacagctgcaccacccagaagccgttttcggggcacttggggaccctgtctttccggctcacgttgtccctgcacacacccagggcccacaacgcgtccccggtgatgttcatgcccacctcccagtagtgcctcccagaggagaaggccgtctggcccacagcacaggggtaagccacaaatcggtccttgctgcagaacccactgccctccggcgaagagccgaggtagcgcctctggcggctctcatacaggaggaggtaggggtacgcggaggtggcatcaggcaccacatcctctgtagatgggcgtggtggtggagagatggggagaggtgtggggcattcagggtcaaaggtgggagtccccgggccctagtggtggatgtggccaatggtcccctaactccgcagaggcctcccctgctgtgaatctggggttacttgatgcttccacacaccaattgtgtgtgggccttggtggcaataaggtacagggggctgggcagagagaccactgggaactcaacaagattcatcccatgaattagaaccaccagtaacgccgccctacgaaggcacagtgaatagccagtgaccgtcaccaggcagtgcacttgtagaaccccccccattggtggcttccgaggctagggggtacagtggggcatcgccaagagatcctgggtcagaggtcctggccctgggtgcccacttacctagaaagcctcttagcacttcaatctgtccgggaactctgcacacagtcctgggtctggttgggggggcaacctctgggcactgcacactcacgttgttcttcctccggtgggcacacacaggggagtcttattgactcccctggcccgacagtcttattgtcccccccgcccaccgctgccactgcccccgcccctgcctgaggggaccacatacctgctcaggggttccttcatgtcctgcaaaagacagggacggagggtggggagtgagccaagctcctggctcacctcaatgtccctgctcccttcttgtccgtgtcttagggcaagacccatcctgtcccctgggcattcccttcccacaattgagcttcatggcactcctgagccttccccactgccctagctcccactaccaccagagcccccagtgcctcacctaagctgagctaccctgtcagcccacggccacacgcctgaggtcctgcaactcaggagaggcggagggaccccttccaggcaagtggccactcaacactgaccctcctctcccatttcaggtgggtgcagcccactcagcaggaatggggtgggggcgcaattgggtgcagtttggggagggaggggggtgggtaagagactgaggcacctggggattttctgtagcctctttagggattcagagttccctaaagagatcactgtttacttctctggcctggaagctacaagggacttgttttccaaaggccatatttctagttgccagagcgtgaccctaactctaggcagggactctcatgcaggtggcgcgcttggccctctgctcataggagcacccttctaccagctgcaggggcttttccctcagttggtcagcaaaccaatgtagtgggttgtgaacaggctgctttgtttttccttttccttttttttttttttcctagatgtgatctcaccatcacccagggtggagtgcagtggcgcaatagctcactacagccttgaactcacgggctcaagcagtcttcctgcctcagcctcctgagtcctgggaccacaggcgcacgccaccatgccctgctaatatttttaagtttttgtagagatggcgtcttatcagccgtaatcaagccccctctccagggccatggcacacaggctggtcccggcagacaggctggctgcttcacctccccactgccgttgccacacaactcactcctgggacagtgcacctcctccacaccgagacatggagtccctgtcccaaagccacacctggctgccaggtgtcccaagccacctctctggacttggaaggaaatggggacactgtctcaggttggaacctgtaaggggctgacttgtgtccccactaattcacaggttgaagcctgaaccctcaggacctcagaatgtgactgtgtttggagatagcatctttaaggagggagttgaggtcactggggtgggccctaatccagtctgactggtgtctttatacaaggagatgattaggacagagacgtgcatagagagatgatgccatgaggacgcggggaggagacggcatcttcaggcctaggagagaggctcaggaggaaccaggcctgcccgcaccttggcctcagccacccagcctccaggactagcagactgggagctaacagccctttcccgttggctgcctcttccccaagcccagcgccccctgcccatgcctgtcagagctcacatcccaccctgcctgccaagcctactggctcacctgcagcatctggaggggcccctgtgtgctccgctcctccagctgcagcagcagcagctccagagagtgaccctgccggtccaggcaggccacgctctcccggagcctgctggcagtctcctcttcttccgtctccagagcctggaggagcctctgctcttcttccaccaggtagaggttcatcttctcaaactccagcacaatgcgttctctccgctccttcaccttgccctgcaggagtggagaagcccagcatgttgccagcaggtggctcagctccagggatgctggcacctctccccagggccctggtgacccacaagatcaccagcaactggagctttagttggggaccaggaactgtgacagaggcccccacctctgccatcctgtgatacactgagtgtaaccctccgagccccgaactgcaacttctacacatccaaacacccatgcacccttgctctgaggaggttcagaatgtccacccccagataagcctcttgggcatgttaaacaaaatttatgggtggccattgttttttgttttgttttgtttgagacagggtctcgctcagttgcccaggctggaatgcagtggcacttattgcaaccttgacctcctgggctcaagtcatctgagtagctgggaccacaggcatgcaccaccacatccagctagtttttaaattttgtgtagggacagggtcttgctctgttgcccaggctggagtgcaatggcacaaccacaactcactgcaactttgacctcctggcctcaagtgaccctcccacctcagccttccaaggaagtgggacgacagacatgtgtcaccaccaccatgcccagctaatttttaatttttttgtagagacagggtcttgctatgttgcccaggctggggttcagtggcatgatcatggttcactgctgtctcagactcctgggctcaggtgatcctcaggggccactgttttgaactgggctcctgcgctgggtcctagaagaccagacccaaccagaatggagtcactggtgctaatgaaaccaaggggttcactgatcaggtcagcctgccctgattgctttttgttattttgtttttcctttttccatgaagctgaaggctgtgcctctgaatgctgacgcccacccttcactggctctttatagataatattcacaggtcaccatgggactggtcgcttcaggaatgtggggcagctcctgtccagctgaaaccagttgagaccatctgcccttcaagtggacctgtcccagtgcccgaggtggccttttgatgtgagagggccaaaacttccaacctcagatcatgctaaggctgccgtttctggtacctgtgtcctgtgaaatgccatgcaccccgacgacacctgcacagaatgggcctgctggaccaccctgcctccgtagttcataaagactcccaagctgtatcacttgggaggcaggtttaagagctgttctccctcctcttcactcagtggccttgcaaataaatcttttctcttagctgggtgcagtggctaacgcctgtaatcccagtgctttgggaggctgaggcgggaagatagtttgagctcaggagttcaaggccagcctgggcaatagcaagaccttgtctctacaaaaaaaaaaaaaaaaaaaaaaaaaaaagctggtcttggtggcaagtgcctgtagtcccagctactcaggaggttgaagcaggaggatcacttgagtccaggaatttgaggctgcagtgagctatgattgcatcactgtgctccagcctgggccacagagcgactctgactcaagaaaaaaacaaaaaataacaacaaagatctctaaatctgttttaattttgtgttttgacaggcattaggattaaggttaactaaaggccattgagaacccgcagaagcaggaaaacctgtttgcctcccccattagctgcctaaaaaaataaagtgcctggcctggcgcgatgacttatgcctgtaatcccagcactttgggaggccgaggcaggcagatcacctgaggtcaggagttcaagaccagcctgaccaacatggtgaaaccccatctctactaaaagtacaaaagttagtcgggcatggtggtgggcacctatagtcccagctgcttgggaggctgaggcagaagaattgcttgaacccgggaggcagaggttgcagtgaactgacaccgcaccattggattccagcctgggcaacaagagtgaaactccatctcaaaaaaaaaaaaaaaaaaaattaaaaagtgccctttcatgaaggaatttccagtggtcaaggcatctataccagaaagagagttccaaaaacaactcttcacctgagacacttgtttaaatacttaaccaacatcacctgcctccccagcccagaggcccccaagccctattcctttgtggtgctgacctacgcccctgccctctggctgcctcctttgtggtattgagcccccaccttctggctgcctcctttgtggtactgagcccccgccctctggctgcctcctttgtggtactgagcccctaccctctggctgcctctttgagtctgatttttgaggccccttctctccaccctatgtgtgcatctgtaatttaaaattgcctttttatctttttctctgctgttcatctgtcttaagtcagtttcattctgaggccagccacagaacctagaagggtagaggcaactttcttcttttcctgccactgcggcagcatatccccacgggcagacacagacgtggaaatgcaggaagatggagcagcagcaggaaagggactggacagccctgggcacccacctgccactcggctaagctctgctcctccctggcctgcagattccctgtcctggtgatctgctcccgaaggtactccatgtcctcctccagcttcaactgtgggacacacaaaccgcaggatttgggatcagcgatccccctacctcctgcctagagtccagttgtgctcgctgaaactgcacccaccccagagaccctcctcaggaggggcaggggatcaaaatacgtcacccagaatgtgccaccttggattattttgagctgaaggcacttaaaaaagggcaggtgtaagaattgctgtgaccctcggccttcctaagagcagaaggcacagccaccatgccagagaggactgccctaggccaggaggaaagccatgttcttaccaagggcgggaaagccgaaaccagagaaatctgtgcaaagggaccctgctaaactaaccctcatcctcctcaggtacatgtttggctctaacatgcttccatgggcctctggctccttgggagcgactcctgggtcatggaaagcttacagggaatgaatttcagtgctttgcttctgcttatctgtctcaaatcagtttggttctcagagccacccaaaatactctgagaggagaggtaagattttgcaatgcctgcatcatacagtgtaggcccacattgtccccagggacacccctacccagccacaggccaccttgtcccctggatgcctcctccccagcccctgactcgggccactttgtccctggacacctcctccctcccccatgatctgggtcaccttgtccccctggatgcctcctccccggccccttgacctgggccccgatgtggcctaccttgtacccctgcactgcctcctcggcgggcagcaccctgtgcagccggtgctcccgggactccctgcacaccacacagatggggctctggtccttctggcagaaaagcttgaggggctcgtggtgctcctggcacaggtcttgcttctgcagaccaggatgctgctgcgccatctcggccaccttggtcagcagccggttgggcagcaggttcctctgcggggacatctctctgcactcggggcaggggaaggagcccttccgcttccgcctccccttcttgcccctcgccttttcccagctcagctggatgcaggctcggcagaagttgtggccacaggtggtcatcacagggtctgtgaagtaatccagacagatggagcacgtagcttcctcctgcagttttctggcgagttccacagcctccatggctcctgggagacacgaggcaggttcccgcttgagggactctggagagagttggagggagcagcccgatgatctgggcgccggcagtgtgcaaccgtcctgtacagcctccctttacagaggagggctaggactgcagtccagttagagagtccagagtcatcatttttagccttgtcaacaacagacacagatgcctccccagaaactacacagaccctccctgaccaatgctctgcaggcccctccgcctctcctctccactgggcctggaccctacccgtccacttccgcctgctgctggctacccccagctccacattccaactcccccatacatccccagctgtctttgctggcgcaactctcccattgcaagtagcctgactaaagagcctttcaaatgtcagaattttttctttaacaaaaccccgtacaccaaaggaagaagggatgggctatcagaggaaaaaagctctcttccattcggtagtgaggtggggttcagaaaaaacacgcgtgtgcatgtacgcacagacgaacacccatacacatacccatgtatgtatacaaacgtgcatgtgcacacacgcatacccacgcatacacaccacacaaatacaaacatgtacgcacagaaacactgatccacaaacacagcacacacaggcacagatgcacatatcggtaaacatacatgcatgtacacacaggtacacgcgcgcacacacgcacaggcacacaagcatgcacatagatgccccctgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacccggcgccagccctccgactccccccaagagccctaacggaggcacccagcccaccctgaccgaagccgggcagggacagcggcagcgggcctggggctctggctctggctgccgggatggctgtccttcccgctctggtccgctagggtcccggtagagttaccttgttgaagcgcgctagcccctccagggacgcggcggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtcttgttggcctggggtgggact

SEQ ID NO: 5846 - DNA, 578 bp, Homo sapiens
ccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctgggctgtgtcgtcccaaagatactaagtaacaggcagaattggatatggcacaaatttctgtttaaagagatgcggtctcgctctgttgcccaggctgttgtgcagtggtattcacag

SEQ ID NO: 5847 - DNA, 1906 bp, Homo sapiens
gctgaagccactcagggtctcctatgacgtggcatcctgcctgtacatctggaacactggctacctcttccaggtggaatttgacgatgccaccaaggcatcagttctagaggtcaggagtccaaaatggttttcaccaggctgaagtcttgtcagtgcggctttgtttctccacggaggctctggggcagaatccaatgccttttccagctcctccaggggccacctcatcgcctggccccaggccttcttgccatcttcacagccagaagcttccttgcttcatgcgcagaccctcgtgactccccttcccttataagggcccccatgattactcagggcccacctcaaccatccacggtcatctccccaccacgaaatcctgaactgaagcacaggcgccgggtcccttttgccacgcaaggtaacactttcccacgtcctggggttccaaacctggacatctctgggggctgttattccacccaccgtcatcagtgaggcgccttcaggaggggctgtgaggtcacgtgaggtcggcttcagaagggctaggtttgagtgcctggaggacactggcaggaggcgcccctgggctccatccatttaccacgcacgcactcagcacccctgagaccatccctggggcctacaggagaaccctgtacctcagcagccctgaaacctgctttccacttccggacctttctgaaatcaagacgcatctttagatcaatggcatcttactgtgtcaccggcaggcctcttctttcttagtgacgtttaaaggaaggtatcttacccctgatggcttcttggagtgaatgaaattccggtgtgagcaggcactagaaggggcctcacaagagtgtcaggtgaccccactccgccctggcccccaagtctttcctagttgctcatctggccctttctgacctgggatcccaagtgtcctgcagctccagtgcccagacccccataactaacagaccccactaaagccacacacatgctcagctctccaaccacggtggggtccaggagccacccctcccgctaggtgtgcctaaaccatggggatctgactcaggggctctctctcggcctggctgcaagctgaaaacacctgggggcttccaaaatgcccaatgcctgggccacaacctagaccagctcaatctgaatctccaaagagatattacagctccccaggagactccaaggggcagccagagtgcaaaaccggaagaaaccatctaacgtggggcaagggaggcgtaaggcaatgctggtggggcgtggaggtggagggtgccaggcccaggctatagaattacatctgtctatttcccatgcccctgccaccagactctgaattcctggaaggggaccaacccagctacctcagtttcctcaaggcactagccctgtgccaggcacatagtggggtccagagaatgtaggccgcagggcctccaaggccaggcagcaaaggctttgtgccaagaaaggtctgggaaaggagcccactgggtctgggccagccctttgattcctgtgatctccagtgagtcactgcccctctctgtgccagtacaatgcacacttggcccacacttggccactgagtttgcacttcactgaagggctgtgggaacgacggcaaggatagaggaaagccagattagggaagacactggctctcagaaccttagggatctcggtcttgggccactcatcccacttctgcccagcatctaaggagcttgagagggtgaagcgagagtaagagggttccatgctcacccccaacagggtcccaatgtcttctcgatgccctggtccttctgggcctaaaacatccacttctggggctctgtcctctggtggctacaaggataaagaa

SEQ ID NO: 5848 - DNA, 3272 bp, Homo sapiens
ggttgcaggagctgcggctgcaggagcggcaacagcagcggcggctgctgaggggacaggaatcgcctccgcttgcggcgttcctccaacttcttctccgcccagctcaggcccccgcctccccccagcgccgtgtccgagctgctcggcatcgcctagagccagccgcagagcgcggcgcgggtgcggcctcctcccgggtcagatcctggccatctcccccgccggaaacgggagcggcggcggagggacaccgagcaccagagccggccgggaaaagcgccacgataatccgggtcgggactcgggtccctgggttccaggtcacagtggggtacgcagcagcctccgggccccagggaagcaggaatccgggcggcggagctcccgattgcgctcgtcgtcctatcctcggcagcgaaaacaccagatgcgccgggcgctgacctgcgggggagtcccgagtcctccaagtgcccccgggggtgggggagcggccttggccgcgctctcggctcgggcagcgcaacgcggaagtaccaccttcgtcgccgcttcactccatcgcgccctgacgttgggtgcaagttcaggggaggggagtgggcgagacaacaacacgcctccaccgcctcctcctcggcgtcgacgtcgtcctcctgtggtggcggcgacacaccgcaggcgcctcggaagtggcctgggcctgacaacaactcccggcctagggcctcgcgcactctgcggcccgcggggctgggcagcggggcggggcgaggcgggggcgaccgggctgcggctctcggttggggcagcgactgtgcggggctgggcggggggctatttccggggagatgggggcaggggcgtttctgagtctgtggcggtaggtacgggccctgactttcttcttctttcgccgccgccgccgccgccagcagaggtggcggagctacccctttcctccgctccccccctccacgaggaggctcctggtgtgcgcggcctgccccggctcgctcctccccttccctctccgctcctcgtcaggaggagggagagcaacgggacttgctggttgggccctaacctccacaacccctccttctcgcctcgctctttcggcttttcccctcagccctgacgtacgaccgggagcgcgcccgcaattcacgctcagagaaagccgaagatgagaggtggccggggcaagagaggcgggaacaaagttaccgcgcactggcgtgctcgctcccgccaggggccggcaggccgcaccggaagtggcatgatgtagaaaccgctcggcttccggcgagggtgggactccgtgtgaagaagggttaaagaaaggagaggattcgtgtgccgcccactgctgttgcttgagactctgcccgtggtggcgcgcctgtcgtgcttgttgcttgcgtccagcgcgcagtgccggttccggctctgcagacgccgcactgcctgcctgttgagcgaaaggtcacagtgagaacaagtgtttctggagactgcgagggaaataatgctgttggtggccttctggagtaggcagttaccccccgtgtaccttcagtcaagccctgggagtggaacagctgcgaaaggagagaaaacaccccgcaaaacagggtggagatggcgttggtttaacttgtctcacgtacgccaaagttcgaggccccattttttttttttttttttttgagactgagtttcgctctcgttgcccaggctggagtgcaatggtgcgatctcggctcaccgcaacttccgcgaggccccttcttatcctaaaaaacacacttgggaatcacagctcaagcttcggtaacactatttactttaaaataaaaatttttaaagctttaaatcaatacaggaaataagtggaatgttaaaaggaactactgaaaattccaaattctcaggaggcttgaaataaaaacatcttgtgcgaatgaggactgccctcttagtacttcacccactttcaccttcatatctaaacctttggggttgccaaacatagccatatagtgacctcacatctcatttcttgccttagaattgcccttcagttacagactaagcactcgggataattagattaaaatgtaaatggcttattggcttttagaatggttggaaacgcaagctaaccctgtgcagtggcacacgcctgtagtcccagctactccggaggctgaggcaggaggatctctggagctcaagagttcgaggctggagtgagccatgaccgtgccacagcaccccagcctggccaatcagcagggcgaggccctgcctctaataaaagaaaaagctaagccgtctgttcaatgactaaatgtagtaacccctttgaaaattcatttgttcagatcatcagttggtttagttcttaaacacttggtatctatccatcgttaataccttagtgtaaattattttaatcagtttgacatcacagtatcacagactggcctgatttaagctaagatcagacttcactgaccgagtacaaaggatgttggtttgctgaaggataaaggaggaggcaaaggaataggtaatcttaaagtcagagcatttcccaggagggcaggcctgggtgggcaacaccatgggatgggcattgggaaactgaatagaaaaatagggggcagggttcctaaaacaaatttctggttgacagtattgttgagtgaaggtcctgtagccagcctcctaccaaagactgtttagcaagtggctttttcagaaacatgtaggatcaacttgttccatcgtcctacgttagatagactggaataacagaacaaagagagcaaataagaggtttagcttgcagctcccctcgtgtacaaccagttccacttgagaatgtcatcttctatcatatattttcaaagaaaacttgatccatagtaaatggataattcccatgtgtaagtgtattaaatggagaagaagggaaaaaaagtaaatggatagttcccaatccagggtgcaaacaaaaaacatgtactaaaatatttttactgtggttctaccacccacgtttcctcaaagattctacctttggtgggggaggttgaatgaacattttgagctcaagatacctgcccacgtggttggaaacactaataactaataggattcaaactccaaaaaatgggaaggacctttgaattagaagccgtctgtttctataagcctgtctgcttgcctgaatattaaagagatttgaaattccc

SEQ ID NO: 5849 - DNA, 812 bp, Homo sapiens
ctgaccttttccatgaatgtatatttgctacttgttcattcgttctgtcatctgctggcacttgctctctagaaatgtgaaaggtcatgagctcatccaggacttgctatcctccctgcatttagacagttcctacccacctgatgctggcctgtctgatgatgatgagcctcccaatgccagcctgccccccgacccgccactcctcactgtgccccagatgcacagtgtttgtgaccagtggctgcaggatgccttccacatcagcctctgaagagctgggggtgggtgggcatgcacccatgcaaaaggctcagagactcccccttccataagcccttagactgcagtgcttgtgcctttccccatactgcctcacctcacaggagggccaggcaccacttgtatctctcagatgcaaaactgccaacccctttctcctgtcttgggttggctggcactggggcgggcacctagggtatagtctctgcccatggcactgggcctccatttcttccacatatgtgtacctccagcttggccaaccctcagcctggctgtgaggcccaaagcatcttcccttccccttggagtctctgggattgggatgagtgtctggctcccatctccttctccccttttgtggctattggcagctgctggctcaggggcatcccacttccaggctctgggttccactctcagggaagggctctaggacccattcctacacccacccacggccaggagggccaaggtcccatgctggatatttaaatttagaggctggcttccagggtgcatagataaat

SEQ ID NO: 5850 - DNA, 2713 bp, Homo sapiens
tttttaaactttttttatttaaataaggagaattctttcatatggaaagagctagtacaatcacatatttgaaaggagaaacaataggtactgaaccggagggaaagggcgagggtgagtgtgccagcaccggcctggtgaatccacgattcgatttcccatccaaggtaagtttcccaaaataccgtataaacaagctgcacattacacctctagccatcgtctgccctttcaaatatctggtctacatggaaagacaaagaggaaaggccaaaacataaacaaaaggaaacaaaaacaaaacacaaccctctcaggaaccaaacaaaacccccaaatccttttttactacacaaggcatgaggtcaaaagcttgagtacagtgtcccctttagatcacgggagaaaggcgtccacacagagccttagcaggaatttccactctgaggcttcagaacatgctgaagatggggctctgagggtgccactaccatcctggaggccaccaagtggggtggaaacagtgaagagcaggtctcacatgcccgaagaccaccagccaactacacattggtggccctggtggagcatggctgggcgacagcgtccatccccaacactgagccactcctgtcctggatgacttcctgcttaggtccgtcacatttcagaagagagctggctttctggaagcctacgtttcccattcatcacagaacacgacagagtgcacacatcctggtatccttggtcttcaaaggccatttccagcagaccctctaacccaggcttgttctgcaggaagtgaaaagggacaaatgaagatttgaggggcagcctgcagctacttggcacaggggaaccaaatggcaagggagaaggctccaccagagctgccatgctgccgtagcaggccagaccacagcatggctgtgcacctgtgtgtgctcagcttccagaagctgtcactgaccatcgcgaaggcagatccagaagataggagggtgacagcacggctggagagcactgatgtcaacgtttaacaaggttccccagtgtccctagaagtggctggaaggaccacagctttggaactgaactgattttcttgaatgtgaaataaagtcatcttttgttttcccccttaaggaacctagagccagagtgtctatgaattccaagtttgaaaacaatatgaatgtttaaaaaaaaacaaaaaacgctgtggggagaagccaacagttaagaaaaccaaaccaaatgcagctggcattgaagtccccagtgggtagatgggcatctgagatgtatacccacactctggacttcatcccactctagtggatggtggacaataccgcaaggccactggtggctgagcaacgagccgcatccccagtgaccaaggcagagctgccagcgtcaggagggcaactttaacaggcaaaagtgagtgggttctgaccccccaatccctacctcagcagcaggaaagggaagtgctggtctccacctgttcccactaaggccccgtggtatcctggcagaagcctctgcatgtatctgcgctctgaggatgggggtttgaaaacaaaataagaccctacgtcctactaccttgagcttggctctaaaaccacgggaaaggaagagatatattgcaccttaaaacatctctgcactaagaactgcatttcattagaccaaggaggggttggggcgctgggaggcctgaggcctgccctcagccccccaagtctcatttaaaacctgcatctcagcgaagagactgcagctcaggtcacacacaggtggtgactgcaccgaacttcacatgcaatttcctggcctttcctgcacagaattaattcagacattatatataaatagagcagtgaaacatttacttctttttttttcacctagacctacaacatcaatacatataaataaattctagtgttttttgtttttttatttggggtgggggaggagaaaggaaggaaataccaggtaagagaaaagggctggagaacaggtgacctttttgtttttattttttctcaaacagcaagtactgtgggtctgataccaggttcacctgaagggtacatcttaacagcatccagaaggctttcttttgacaaatcacacgcaccaccgcatcaggtgggaggggtctggccatgcggctcaagtgtccaggtggagatgaatgtgtggctcccgcaggcctgaactcacccaggaatggcttggcaaggagggccggtggggacagagagggctcatcccaggccccacaagcagccgcttgcagtgggagaaggaaaagcagacaagaagctcaggtagggaatgcctggaactgtcgggtgggcagcccctggggaagggactcaagcataaaggcttgggataaagagggaaaagaccaggtgagggcaggaggggagctgctgaaagatgcaggtgaacagtaaagcacctttcagtaaaactgccctttcccaggcagctctggggtgggcgctgttggtaggaggccgttctcccgcttccttagaattgtgagagcagtaagaagttacttcagcagttcctaagatgctccttccccatgttctacactagacacagagcttagagcccaagcctgagcgctgtcctgcacccgtgagacgctgaaggcagcctctggtggggggtgcat

SEQ ID NO: 5851 - DNA, 333 bp, Homo sapiens
gatgtgactcactctcattaggtagcgtggaaggagccttcggatgggtgagcctgggcgcgtctgaggaagggcaggcgggggccgggccacctccctgcagaccctggccggctgctggggccggggaggagagccagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtg

SEQ ID NO: 5852 - DNA, 7793 bp, Homo sapiens
aggccccgctgggcgcaggcctatggagggcggaaccctggagcccccaggggagggcacggcgcagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgaggtaagtgatggtatccccatctcagagatgaggaaccggaaactcagcgaggttaagtttcaccttcctgaaaatcgggcaccccgtttctgttccccagagggagctcaattcaaagtccccaaagaacaggtcttctgtgaagacctgttctcccctcacaaccccgttggaaaaagcagtgggagcgacccagggcggaccctctggcccaggcttgtgggttggggggcagaggggcctaactgggtggccaggtggcccgcagagtctctccagcagcagatggcctccccagccctttccttcagagcctattaagcagtcaaatgggggagggttggcccccaaggccagggacccagcagcagcagcagctcacagcactggagccgttaaaaagtgactcaaccagaaagtgcgtttgaagtgacgcccgccagggccccagagccccagagccccagagccaaacctcaaaaagacgaagtgagagagacaggcctgcgggggctgggccgggggtggagacccagcctggagctggcctggccaaataagggcaaatgcactagggcgggccaatggggcaacagcggctggctgcgtcatggggctgcggctctggggagggggaggtgagaagcctgggacaaaatgggggtgggtgtcaggggtcccggcacctcttcgaggggtcccagggtgggtgaacacaggaggcatggaagccctcacccccaaggagcctttgttactaaggtcagtggacctgcaaccccagagccccacctgcaggctggatggggttcaaggaagaaaaagggaaacctggaggacccccatgcccctgccccagttatgggccctggatccccatctgccatggagaactgaagggaggccatagggacagcagcgttgtgcaaggggaaaggctgaagcaccagtgcagcttcaccaggccactgactgtgggcgagagatgtaatggaaactcagttttctcatctgtgaaaggggaataatattgcctcgtgggatggcactgagggtcaaatgcaataatagaggtggcccattttgaacctggaaattgccatagggatgtaatagatgattagtgtagaggcacaaggccaaaggctgcttcttagattcttgtttccaggtgctataaacgatccctttgcaaggatatcatgtggttctcaattttggcccctggtgtctagaacaaggtagggggaggtgccaaggccagagggattcctgaatcttagtccctaagcaaaagcagaagagactgatgcctgcctgcctccagctgattccccagggacataccccccttcatttctcctgcatctcctcaccttccatgaatccagaccatgccccacccctcctcctgagaccccgccctccatctcccggcctctctggggtgcagggcagaggaagtgagtctactcagctgaccagagaaagtgctgcagctgcctgcacagggtgggccgactgctgtcttgttcagtgcctgtgataactcccttgcctcaggcctctccagcccctgctgggaccactggcccaggaggaagtctgggctctggctgccacctgcttcctctcaggagttcttctccctcccaagcatggatttgcatttccccctctgccttctgctactcaagcccccagggatgaggtgacagttaaccccccacttcctgctagtggccccagagcgctcacttccttccaggtattttccgggatgggggaaggggttgaaagggtggtagttgctgggtttggaaaggggatgagggatccattttggagagaaactgaggtccccctaccctgctgtctgaagctgctccttcccttccctcacgctcactctgtaacacaagagctcagtttgcaggaagaagagtgcataggccggaagcagcacacaggggctttcaaaatgggctaggccagctctctcttagaggcccaggcctctatccgccatagatagacccccaaggaaagttccttggacttcaagttccctatcgggacaacataatgtctgccctctacccggaaggcagagggttgagaatgggggagtgccaaggcatagaggggaaatgttttccatcctatttctcagaggatctggcatgctggtaccagcagcacaaggcagagtgttctctgcactcagttcccgcttcctgggatcttatggcagagaaacacagcatctttagacaagaggtactgagctaggcagtgtaggacatacaaagtagcagcgacccgctcctgaagtcaagctgaccagtctctggggctcagtcctctcctctaaaaagtgaggggctggcctaagtcatgactcccccagtcctaatgttctgtggtctgccttcactcctctgtagactctgcatttcaccttcccactggtgaaggcctcgaaaccccaagactgaggcaggcagccatgtgctcttctccccagtctaaaccttattggtgcaacctatagcaatttttaccaagtgtggctgtctgttctcctaggtcagacaagactggaagggggacagccacacatgagcaacagaagtgacagctgacaggttgctatgaatccaagaggtagaaaaagagtcagtcccggaaccatttcaccacatgatacaaaaatggaggtttacaacaatgactttgaaccaaatcaggttaaatcacattcagaatcttgtatccaaatagcaaggaagtatataacacatttttaaaaatttaagctaggtgtagtggcacatgcctgtagtcccagctacttgtgaggctgaagcgggagaatctcttgagcccaggaattcaaggccagtctaggcaacatagtgagaccctgtctaaaaaaaaagaaccacagaaaaacaaacaaaaaaacaaaaaaaaaacccaaaccaaactttatcttataaaaaacgagaacataaagattaaaattttaaaaaaaccttggccaggcacagtggctcacgcatataatcctagccttttaggaggctgaggccgaaggaacacttgaggccaggaatttgaaaccctgtctctacaaaaaataccaaaaatacccccaaaatgagctgggtggagtggtgcgcacctgtattgttagatactctaggagctgaagtgagaggattgattgagcccaggagctggaggcttcagtgagctacaatcgtgccactgcgctcctgcctgggaaacagaacaagaccctgtctttggaaaaaaaaaaaaaaaaaaaaagccctggtgcttgaaggaaaatgtttctgttttgattcagttttgatgtatttatgtatgatatatgtggtggaacacctattaccattacccaacaatgctggaaggatgaaattcttgtcacacctatctagaacttacctagagataggcaaccttggataatgacaattccttacatagtttacaactctcaaattgcttttgcctaaattattgtatttgatttttttttttttttttttgagacagggtcttgctctgttgcccaggctagagtgcagtggcacaactgggactcactgcacccgtgacctcctgggctcaagtgatcctcctgcctcagcctcccaagtagttgggactacaggcgtgtgccaccacgcccagctaattttaaaaaaatttttagtagagacagggcatcgccctttgcacaggctgatctcaaacttctgagctcaagcaatccacctgcctcagcctcccaaaatgctgggattacaggcgtgagccaccacacccagccaaagcaaactttttatttgaagtataacagtgaacaaatcctaagtatataacaatatatttccagaaagtgaactgacctacataactagcatcaagatcaagataaaaggccggacgcagtggctcatgcctgtagtcccagcagtttgggaggccgaggtgggtggatggcttgagcccaggagttcgagaccagcctgggcagcatgacaaaaccccgtctctaccaaaatataaaaattagctggatgtggtggtggatgcctgtagaccccgctacttgaggcactgaggtgggaggatcaactgagcccaggaggttgaggctgcagtgagccatgatcatgccactgcactgcagtctgggtgacaaagtgagaccctgtctcaaaaaaaaaaaaaaaaagtgaaagaaaataaaagaaagaaagaaagggaaggaagggagaaagaaaagaaagaaaaaggaaggaaggaaggaaggaaagaaagaaacaaaatataaccagcaccttaggtgcttctcatgccctcctccaccaccacctatcacagctaaccacgatcctgcccttaacatcatagttttgtcaactgcacttcctagacaagaaacttcattttagaggtgacttgggaaagtcacagggttggtggctggtggaggcagcagggccaggactctgcccttagttagatacatgtattttcatcgcacaagtctcagtgttccagtggggtgtgacggtgccatcatcagtctgcagattgagggaggtgaggaggaaaaagagaggttgggaggtgtggggcacacaggtcagcaggtgcgtaagagctgctggagtggaatagaagatgcagccaggggtaactcatgaagggctagactggtttcccaatgctctgcacaggaatccttgagtaaatcccaaggatcccctccctgggccattgccccactgcctccatctctttggctaattttagacttagggactagagtggtgggattagagtggttggtgggctcaacgtgtagggacaatgtgttgtaataacttcactcagaagaaagctaatgcctcacactggttctgttgaacacttatggagggaaaaaaacttgctgtgtttgtggacaactatgtcacaaacagttagtagccctaaacttagtgtggacattatatttcttgagctgaggctccactacttgattatggctaaaacacttttaactcttttcttccccaccccgagacagagtcttgctctgtcaccctagctggagtgcagtggcacgatcttggctcactgcaacctccgcctcccgagttcaagcacttctcctgcctcagcctcccatgtagctgggattacaggcgcccgccaccacacctggctaactttttatatttttagtagagacggggtttcaccatcttggccaggctggtcttgaactcctgatctcatgatccacccaccttggcctcccaaagtgctgggattacaggcataagccaccgtgcccagtcaagacactttaactctttgagtctcagtctcctcatcaccaaataaggatgttaactagttccagggtttctgtgagaatcaaatgagatactggatatgaaagccctttgtcaactgtatttgggtttgttttgttgttttctgagacacggtctcactctgtcccccaggctggagtgcagtggcgccatcacggctcactgcagcctcaaactcccagactcaagggatcctcccacctcagcctcccaagtagctgggactacaggtgtacaccaccatgcctagctaattttttgtagagatgggcttttgccatgttgcccaggttggtcttacactcctgggttcaaagtgatctgcccgctttgacctccccaaggtgctgggattagaggcatgagccacagcacccagcacctttgtcaactgtaaaaatatttacatgaaaggctttactgatactaaacatgaaccagacttccagacaaagttattattagtctgttcttaaacatgacctacctgcctctttcatagagaccagatgtcagggaggggacctgaggatcaagtagcaggctgcagacagactaggagtaacaaggcagaagccacaccaagagcaaagcctcagttcccaaccctggtgaaactgctcccctccaagaccagaccatcctgacccttgctctatcagctaccagtcctttcttgagctggaggctgcattatcaatgcactgccactgagctcctcagtgttctgggagaccctaattccacagtatgtggcagggaggaagcagggaatgaggcaagggcaggcaaggggaaggcagcctggctactattcctagtctctgtctgacttgcatctgtccttgttgagctagggaggaggcttgctcttcaggagagaagccaaactactgagcaagacaaggagagatcttaagatgctatgcactcagaacttcggcagccaggacgggactgaaactctgacagacacaatgggccaatggggcaggacatagctctcatggctgccctcatagccatggaaagcagggcagcagtaccaggaccgcccactcccagggagctgtgaaccaagtccttgtcttagtttctttgggttcccagtagaggatgggactccagcacctttctgcctgtctgggttgctgagtggcaccacctgcatgttcaagtaccagagaaagcaagaaagctaattcagcagcagctcccggggagagcccacttggcacagtctgtagagtccaggaaggaaaacaggccacccttcccccacaagcatcaatgcctatgctatgtcttttgcttcctgtgagactgtcagttagggcccagttcagtgtagggctgaggcagcctgaatgtggttatttgtgcaagctcctcttgcctcccctccccacaactgtttccattctcaccaagcagccacgtccgggtcagacacccaggacagcagctggggctttccaagggactttttgagaagctagtgaaagttgggtgttggctgcacagcctgggcacttgctgaaacgcacttcttccatccaggacgtaagctctagcctggcagggttgctttcaggttgaaattgaacagaaatcaccacccacggagctttctgtttgctgggctggggaaatccttgagaaactcagtttggagttggggttatctgaccattccctcagagcttgaaggcaccagagaaaatggttttggtttgaagaccatagtggacatgagcagcccggccagtcccagtttccctcccataggcctatgtgaggacaaggaaggggagtagacaaactaatcagagtcaggtcgcatctctcctccttcccacactctccaggccacaggtaacaagcaaaatcaactcaagagcaacaccaggtggctgagacacaaagccctagcacaggcagctctgccctagcacagcacagctcaccctgcagttgtggttctcagcatttcccctactattttggctgattgtgcacatattctatgtattgaaaaatggcccaa

SEQ ID NO: 5853 - DNA, 21740 bp, Homo sapiens
cgtgagccaccaacatgaactccagcttctccttctccttctgcagctcagcaatctccttctgcaggcctgacttctcctcctccagctcctctgtctcctgccacggaaagagagggatgtgagggacagcaacctgccagggaccaatctaggcaggaaagagaaaaccagtaatgttctcagacactgtgagagcagaggctcacacacctaaccacagaccccgctggtctgagtctctcagtcacctggaggctcaagattcctttcatttccaaagaaggaaagtcagcttggagagggggtaagacaacaactgcagctgccataacccagcacctactttgtgcagggcacagtgttaagcatttcagagatgatctcattcaatcttccaggagttttttggaagcagatgttatcatcgccccattttgcagatgaggaaactgaggttcagaggggttctgttaattttccaaagtcaccgagctagcaggtggggtagcccagatttgattcccaatgtatctgactccagggtctatgttctatggccttggtgccaggactgccccctcggtacccctgaggggtgagtactgcagagatctgcatggagaagggggtacggaacacagctctacccacctctctccttctcttactccccaaccccatgccagcccacctgtggatggataaacgctaagccctaggctgctagagagtggagactttgtcatgcacactcctgtatccctagcacctagaacagtgcctggcttctcagaagtgctcagcaaatccctgtgggattatcacagcctctcctcctcccttttttcactccaatttctttcttttttttttttttgagacagagtctcactctgtcttacccaggctggagtgcagtggcatgaccttggctcactgcagcctctgcctcccgggttcaagctattctccagtctcagcctcccgagtagctgagactacaggcacctgccaccacacccggctaattttgtatttttcatagagatggggtttcaccacatcgaccaggctggtcttgaacttctgacctcaggtgatccacccgcctcagcctcccaaagtgctgggattacaggcatgagccacggcgcctggccttttgctccaatttcttaagcacatatttcaggactcccagaaccctcagagaacatttggttcagccaccacgcttgacacagaagtaacgtgacagcccgagagggcctgtgaggatgccagggtcaccccgcaaggacctcagcccccttctttcatccccagccagagaagcagaagcgagcaagtgcacgtggaggggccgctgtgggaggggaagaggtgtgtgtcaccagcctcctccccacgttttccctaacatggattcctgttcatcagtgaggacatacgggcaagggcttcgttcagcagaggacagcatattccggagtgaaaaacagtttccgtctgtctcaagggtctgacgaacgtcatgagcttctgagaggcttcctgtggaggatgtggctcaggggcctgggtggctgggtcagagggcgggggaggtgggggaggcaggggagtagggtgtgaggcctctgggaggagggaaggaaagtagaggagcctcagggggcagggctattccggggcgggtggtgaggagcgccacatggggcacagctccttgaagtgccaatcacagaaaggttagtggtgggagggcccgctgaggaagtggattgtggatctgcctcacctgggaatgaagaattcccactcatcctccccggctctaacacctccgagggccattactacaggcatcacagaattcacgcaattcaattcattcaacaccccagagtgagggctgcaggacagagaaagacaagcctaagtgggtggatggtacctggaaacattaactcaagtgaggggatgggccaggcgtggtggctcacgcctgtaatcccagcactctgagaggccaaggcaggcagatcacccgaggtcaggagttcgagaccagcctagccaacatggtgaaaccctgtctctattaaaaatacaaaaattagccgggcatggtggcaggcacctgtaatccccgctagttgggaggctgaggcaggagaatggcttgaacccaagaggcagaggttgcagtgagctgagatcgtcccactgcactccagcctgggcgacaagagcgaaactccatctcaaaaaaattataataacaaaaaaagtgtgaggggatgttttccaaagccccatcctgggcagtcactgtgaggaccactgacagagtctctctcatctcctcactctgaaagcattccactggggagagtcaaccctggctcggggcttcctccacacagcacacggcccttcctgcagggccaggctctgaagggagttacgtgacgttggtcaggtcaagcttaacagagggaagggcagggctgcgggtccccaggtctgggcaattaggcggcacgggagagtgactcacaagagcagcacgcggtaccatggccacagctctgagttcatgatagaggtggggaacccgcctgcccataaaggaaatgagaaaaccccaagaaaatacaaccctgctgccacgtgacctatctccatcaagacttctccctggcccaacccagagtgcttaggccaggctgggccactcctgatggcggcaggcatgggagtggctggaacctcgggaagcagccctggatggggcaggtctggacctgccctggctcccaccctccatcatccctcacccaggagcccccacagttctgtgagcagagaacactcaggtgctgcgtaaaaaccgtggctagcacccccacagaaggttgttcatttcttccctctgggccctggctggtgctaaacgccacctccctctctctctctcttttcaatcaacacaatgctgacccatgtgtccaaaggaaggaaagctctatctccactgactcatctgtagggcatttgtgggtaaggagacagctgtgggagagaggatcaggacccccggggctctcactccagcccacccagaggtgctcccaccctacgcagagttcctcaccgcctgcagcttctctgtcagctcccggcgtcggttccggcacttggctgcagccagcttgttcctctcccgccggatgcgacgcttctcctcctcttcaggagacagctagaggccaaagccaaggatcatggttagaacagagacaatggttcacagtattttttaaaaactgtattttaagtaaggcaagaagcccttctggaaatggagaaaggagaaggaagggcaagaggagcatggctggactcagaggccccagaacatgtggatccctgatgtctggctgcctgggagggctcttttgagctgaatctgccccggaaggtgatgtccaagtttaaagtccatgtttaaacaggacagcaatgggtcagagattcactggcccaggcatgatggcagcacctatcacatcagccctgattcagtgctcaggccagagagaaggagctggggatgcttctccaagagtcccctcctgccagccaggcgtggccccacccacttaagcagcttcttccaaaccctggctaatttctcctcccatcactctgcctgctctgcaagcctcattatccccattttgttaagtagctgggcctggagtccccacacaggttaagaaccacccaggggggaatgttatgttgctgatgggagggccaagagtgccactccactcccgatttcctctgccaatcccagggtgccagctgctcacggttcaaccccaggtactcccccacatgcctggtacagtgctaagttggacaggacatgcaaaaggaagaggagcccccagcaggtaaaatcctgctgcccaccatatctgtccactcaacaagtgagcacctggttccatgtgcaagatgaagttctacgggcttgggatttatctgcgaaccaaacaaaggaagattcccctgcaaagagcttaggatctagcttcttccagtgagacagttaggaatctgtcactcataccggaaagcatgaactctgctctactgagcagggcaaatgctctggttctacagagccctgcagagctgtgaccccaatgcctctctcaggcagaggtgacacaaggagacggctgtgggccaaagcagaaagcaacacaaagggaaagcccacccattcagttatcagacgttgactgcacacctactaactgcccggtgctacactaggagcttagaagatctcaaggggaataagacctgggtcagctctcacgggacacctgggggcaaaatcaaagctacttttggaggagcagggagaagctaccccaaggagggatactgcctggacttcaggtcaccccatgaaggaaagagccactgtcctggttgggtccaagtcagagtcccacaatgctccctttagccctggaggtctgttgctgtgatgttttgaacagcaaagagaggacaatcatcacagcaccagagaggacaatcccatgcctgtcacacagagggaagtccacagcccggctgaggtcatgaggccatttggccaaggccctgaatacttcctgctcctaaacctgtcttgtcttgagcccagcagaattgccaagaaagccttatggccctgctgcaggcctgggtttagggctcaccactgaaagggccaccagggctccccttaaggcccaggaagccccctagatccctcgctaatgagaggcagaaaagaaggaggctggccttgacccagttcaagccctccttcccccttggctgcttctggacaacttttggcctcctgactgacctagaagtctctcccctgactggtgaggtgtggggcaacttgtgggagctgtcaacataggaagtgttcaggggcggtgagatcaacatggttccagcttgagtgtgtcagcagcaccatgtacccacccacaagccacacacaccctcccctccccacctcctcagagtcgccgccacagggcacagagggaacctcccaagaggaggcctatgaggcaccaggccggctccggaggcaggctcctccctagcagggaggctgggggaggctggggacggccggagtaagcttcagagcaaagccctgagggctggcaacctgaacagccaaagttctaggctgccactgcccaggcttccttaaagctgctgggagatgtgtgaattcccaactgatgtgggatacaatgctccttgttctctccctccctctcaaaaaaggaaggaaactctccagacagattgtatgaggcacgcctaggtggtgtggtgggaaaaccacagggccaaaggtcaggagaagtgggttccagtgctggctctgctactaattcactgtgagactctaacagggcccttcacctttctgggtctccgtttccttgtctgtaaaatgggtataaagggaaaatgagaaaagatggtctccaaagtccctctggatacaaatttctaaatttggtgtgaggtaggcccagaagagaatggagagcgtggccgggcgcggtggctcacgcctgtaatcccaacactttgagaagctgaggcgggtggatcacctgaggtcaggagttcgagaccagcctagccaacatggcaaaattccatctctactaaaagtacaaaaaaaattagccaggcatggtggtgcatgcctgtaatcccagctactcaggaggctgaggcaggagaattgcttgaaccgcggaggtggaggaggttgtagtgagccgagatcgtgccactgcattctagcctgagtgatagagcaggactccatctcaaaaagaaaaaaaaaaaaaaaaaaaaaaagggaatggagagcattcagcacatcctcaggctttgtggtcctgctagccccaaagagtacctggcaagcctggctctcactcaggatcacttatatcccagaagagtccagctcatcagtgagtataaggctttgcaccttggattccgtgaaggaagcctatttataaaagtccttacaagcatggctactgcaatatttacaactgcaattatagaaagcaactgtgaggaggatactggccacttgctccagcagcagaggcccaacatgcagctgtgaatccattatagtgtctagcagacacacctccccaagtggctctgcaccgtggttctgccattaacagaacaaaccaacaagtagtggatacaagacccagctttgtcctcgcaggagcagagctcctgagaaagcttccagtttcttggtgtggtgatccctgtaattccaagtatcctggggtctggatctaccctgatccactgggaaccatgtttgaaaggtccgtatattggaacattgtggccctggggatcacagagtgaagatggacagtggttgaaatgaggaagggttccaaggctgtcactgaaatagtttcccaggataacaattcatttgaaaaagggattccactgctaaagtatttttcccttccctgggctcagggtggcatagccctggagaaagaatactgcatagggggtccagggaactgggatctagcccagacttccccactcactggccgagtggccacacacaggtatgtctggcccttgcttgtatcatctgacatgggggagaggtggggctctctgaggctttatcccattctttctggaattatgcatgattctgatttccctttccaagaccagggaacttggcactgccctggcttactgctgatccaggcaatgagcctcttgagtactaggtaggtgctgcctaaatagcagagcccccccttccccattttctggcttccctccccagccaggttaattctttctcaaagctgagccccttgaagagaaaagggctgatgtctggcctcccctgcctcatcctcctgtccatgccactgaacagactcctaaggccccagagttactgcacctctggaacatgcattccaggcccttgaaataggctcctgctccgagttggaggcctagaacactgaggaggaatgggaagtcgtgggcagtaccgacccagagcttgaccccgtaggtctgctgggtgcctggcctgcactagaccctgggagacggctaagggataatcctaaaaagctcacagccagggttcattggctgcttgtcccatggcccttttgccaaggatcagagaaggatcctgctgtgggcaggtcgtaatggtccttcccatctgtagccaagtcctggcttgcagggaccatgatccccattttgtggctgaggaaagtgagactcagagattctaagggacataagcgagatgacagagccagcctgagtcttggctctccagctcggcctccagtaagggggatgacgtgctcttcgacccctagctcccttgtctcccctgctctcagaacattaaccctcccagtctgcagaaacccgttctgtgtttctggggctctgaaagccactgacgtggctccttcccactggtctgagctgtacctgctcatctctcctcctgcggcccacggtggtgccaatggtcttgatcacgccaggtcttgggagggccatgtgtccagggacagaggccaggcccggcagggggctgtaggggtgcgagcgagggtatgggttggacatggaggtgatcactgtgggctgcaccatccactgcaggtcctggctggtcgtgatggcgttgatggtggggatgaatgcactgcctgagccaggcatatctacccggaatttctgaaatgaggaaaaaaaatacaaatgagccaataaatactaagctgaacaggatagttaataataattgaacagagctgaggcaaaaaccagcacagagcacagtcagtgttcgaagggcaaggtcaggaccccaggtgggcctggacaagtcctgtgcatccaagaatcaaggggggaatcttaattatgcctggggcttcacgtcggatctgctccctgactggggtcctgagaactccatccccaggtggctcagtgaggatactgtcctattccaaatgacttccaagatagacgtggtccccagcactcacactcggcaggccctcttggcagctctccaggatacacatctgcaggatgtggcacctgggtttttaagcctctgagtcgcctgccaactgtttctcagggtaccagctcaggacaccttgaagggatttgcacaccagtagccttggaccaacaaagatcaccaagggagcatactgtgtctgcctttgtcactttccaaagaggttcaggacagagctatgactccatcagggcacagccaggtccgtgaaaagatgtcctctaacccaggagactaacaagtagcggcatttgcagccagacatcccttgctgtccttgtccctcctcccttcccatcatcagcatcttgcttggggcagactggctgagtgtgtctctctacccagctacataggcattgatctatgttcacagatgtttctgtgggaaactctggtgctgctagtgcagttttctccccgcttcttaatttatgcccagaccacgttgcagagctctctggaacatgctgcaggaagcattctatttaaaatataagatgatgacagagtatagaaactaaaatgggctgtgctccttagcagctggtcctgacctttctccaaggcagctactggaaactgcaagaagcgggaaggagagaagagccccctacttccagcttttcagaggcaagtccccctaatggaacccaggtgaaccttcatcttcagatgactcctgtgtccacataaagcttctccaagtagtttcttccccacttaaaaactgggtgagatgaagacaatagctaacaacacttcctgggcacttactaaatgtcagacaccatggcttacctagattatctcactaattctctctctgagtgaagaacgaccattagctccattttagggacagaaatttaggcttagtgagattaagtaacttattcaaggccacattgctaataagcagcggggtcaggattcaaacccagtccagcctgacaaagaggccagagcccctgaacacagtggtatacaagctccttttccattgctttcttcctcaaaatccagccctaagtgctggttatccacccccactgccctcagacagagtgtcaggtcatcccctatagacctcccctctcacaaagaaggtaccacaggtctgtctggccccgaatggaaccccactatcattagcatggatgctgtagaaccctccctatgctggtccaatcagaccaactaggatagaagcattcgcagcaatggaagctggcaccaccattgtctttgccttgtcacaacatcagggttcctgctgtgtaaataacacatagagtacctcactacagctgacagagctggggaccccttcttgctcaattccctgctatctgcctgaccctagtctgcatgttggaacggctgcctcatcaaccagaccacctcgggggcccaggccaagggcttcagtgaagagagctgcccagcacaatggattctgggattctggaggaaagttacccagtgcaatggattctggggtttgggaggagagctgcctaaagcaattggttctaggattctggaggaaagttacccattgcaatgcattctgggattcgggaggagagccacctagagcaatgggttctgggattctggaggaaagttacccagcacaatgcattctgggattcgggaggagagctgcacagagcaatgggttctgggattctggaggaaagttacccagtacaatgcattctgagattcaagaggagagttgcacagaacaatggtttctggcattctggagaaaagttatccggtgcaatgcatcattctgagattcaggaggagagctgcctagagcaatgggttctgggatactggaggaaagttacccagtacaatggattctgggatcccgtgaagagagctgcccagggtgatagattctgagttgcatttctgaaggcaaagaaaagtgggctttttatcaggcgctgactgaaaagcagcaggtgtgtgcatatgaaggagggaagagtgcagtgaacaggaaagcatccaagtgggaaatgatcttcaaggaggaaaaatggccaattggggctgggctgtgagtaggcagagtcgtgagaacagcaggcatggctgagtgtgtgtagaagcaccaagtcccagacagctatttttttcctgagctgctggatgggaggggcggggagtcaacactgcactcggggtcaggaggcatggggttgaggcctggcttagccactgagtgccttgccctgggctcaaggactcaattccatggatgtaaaggggaatactcatcaaactcactgcactgccatgaggattaaatgagtagctacttgtaatcacaggctataaaagcacgccagtggttctcaaccctggctacacattagaatattccaaggagcttgtaaaaaacacactaatgtcagagcctcgccattagacctctaaaataattggtttggggcagggctctgataagctttttttttttttttaaacccccaaggagagtctgttgtgcagccagggttgagaaacattgctccaaaccaatggaaggtcaccatcaccaccaccatcatcattagatgtgcctgtgtactctgcccaggaggctctggggagaagtgccagctacccactcctgggaagcacccaacttttaaattccatttctctccccaagccaggttctgggtttgaaatgcacctgaggcattcagcacaatggtttgatatgactccctcctccatggggaagctgtcagctttccttttaggaaagcacctaagaaagtcactcctcattccaacaaataaaagtgctcccgttttaggcttggggaacccagcagaaaatctgaagcaaagctgagggacaaagaccccttcagaataagtggatgcctattagcccctctgaggccctctagtccacccgctctggagggcaggtccgtggtgtgtgctccccggtatacatcagccagattcctcgcagcaatggcttggtctagacaaaacaagacagcaataaaaaccagccaggaggtaatgactgcctctgaaacgcatgtacaccttgtttcagacaggaggcaaagccatctggataatacactggctctaaactgcaaggaaaacaatgtcccatccccagaggggcccggggctctgataaagaaggcttttgtctccaagaggagcttctcttggagacacacaaaagtttcaattagatctggcagatgggtcttgtctcaactcccagcatgttattcagaaacgtgttattcagaaacgtgttattcagacactggggtaggagagaagaggtgaagttaggagtttgtggtcccagaagttagcctagcattcttctatgccaatagacccgagaatcagccacatgtcacactggagataaatcgtggttctctacggacgagttaacactaaacacaaaccaagatagagctgctcagctgggggctacagggcagtttcaaacctgctgcatgcatgccaggagtgtgctgggagtgatgggatcaggagaggtaacccaaaacctcactcggctgcctggggctctgtagccaacatgtcctcctcaaggacactttgaagatgctggatgcctatgtagcattccagcctggcaaagcctccaaatatttcactgtgtcaccctgtcaactgcggggtgggcaagaatgcctataaaaggatatagtggtccccatccacctcctagagcagagtttagcaaacttttgctgtgaagggtcagacagcaaatattttaggcttggtgggctatacggtcttggctgcacctcaattctgccactgcagtgcgaaagcagccctagataacatgtaaacaaataggcaggactgtgccactgtattttatttagaaaaatactcaggacatagtttgccaacccctgtcccagaggttcattctcatctcccatgctcaggttggagggaaacgaatacagaggaaataagaaagcaaaaagtcagaactgagatgttcctccaacccaggtagccgaggagacgggctctcacttatcagcttgaacctccagaccctgagccgacgttcaaacccttacaagccttgtggtctttgggcatggaaactcccatcaccctgctgtaccctgttgctagggtgccaccgggctgcttgggaaggatgcgtgtgctccttccactgccaatgagaaagacggccgaaaacacggaccctctagggccaccaaacctcagcaggtcagagaagttccccccacaacagttgctgatttgggaaaactgcctcctgagactctatactggagccttggcttcagctatgaacccatggctttttgctgacaggtattggaactagggtttgggcccctacaggaccggatggggccgagggcttatcccagagactcgtgagtgggcagaactggtatgtgagatggaagtcagggttggggttcttggcccagccccttggccaggcgattctccatcagatagatttttgtctgggttatcaagcattcaagccatgaagccctgtggactctgtaaactgccttgccaggcaagcaggtatgattgagtgtatctaggaagggactgggttctttccctttaagaaccctttctttagattcccaggatggaaaagggacaattccaacatcctagaagattggctcccaagaagagaaaaggataagggcacaatctgtctcatacctcccatcacatccccactgaggtccagtttaacgcaaatactctgtatttttactgaacctgggatgttccccaaagccttccataaggaatttaaccattcttcacaggttctgcgttgaacatcactttgacctctgacatttcattcctctctgaagaaataccactatgtcacaatggaaactgttgctaataagttgtgatttcccaaagcgttacagtttataaatgctgtcttaggtgactcgcctcccttcagcctccacgctttcctgggttcccttgaaagacttactctatcctcctccacctggctgcctgccagggggaagagaagcagggaaggaaagaaacagaaagagaaggccttagccctcgtccaggctccccagctgcttccctgccagggcccttttggccagaagcgccactccaaagcactggggaattcactccactagtgtgtgggcccctttggagcccccacagctccctggcggctctgtactccatgggaatgacacgtcctctcatcctccattaaagccaccggaaggtgagcctaggaaagtctcactgccacgggacagggccgagagaccaggtgggccaggagaaatcttataccttccctctctggcccagggagtggagaagggatagaattaccagatggggtttggaacagatatatttgcctcaatcagggcagctgctgtcattttgaaatactgtggccaccaaaagacaccacatacaacatagatgagacatatccacaaagtaatgatgctatttttttctttgtttcaacaaatagaccggaacgttcgtctccttaattctcacaaccagtatctttattcctatctaacaaatgagaaaaaaaatccaagttattgacggcaaaggtgcctgctttggtgtcctttgtcgtgggcatgctctcccaggtagactctagaggcctgcaggacacagggtcacaccctactttggcctcagcctgatcatccagacttgtatgtcagactcggctccaaagaggcttttggtaatttccaaatatcaaattcacccttcaaaggacaaagatttgttagtagggaggattttcaaaagaatacgctgaaagcaactgcaaaagagggggtactgcaaaacctttctgagtctaagcatagccgcagcattcagataagcatttagtctccccaaggaaaaaacaaggaaggggatgacagtgacaaggatgaataagttctgctgtgtttgtattaagatagagaagaaaaaacaagtctcccaattttaccctcaccttgaataataagacaggcagaagcagaaatgggtagtggaaatgcactcagcgttttggataggaaaattcaaatgcctttcagacaatacatgactgctatttcaccccattccctttgatgaaaaagtgaagctgacttccaccatcaagaatcagcggaacagacaaattcttgggataacattttgtttgatcctaatctacaacatctgtaacatcaaggggaaaaaaaaaagcacccagacccttaatctatgcctcccacattcccaccaactgaacaagccccctcctaatataagcacataggaaaacatgccttgggaatttgaacaaactgtgaaggcaacctaatgaatagacagacatcaaaataggaaaagaaaaaagcactcctttttttatttttattttttattatactttaagttctagggtacttgtgcacaacgaaaaagcactccttttttaaccaggttttatttagaagaaaacaaaaaagaaactcaaagtcaagcagttcctagttaaccacggttaaatatgtggcatttatttgtccctcattaaaaagaaaaagcatcctaagaattccaaactcaccaatttaacactctctgggactggaaaaatacattcccaagatagttttcctaaaaatttcccgtagagggcactagagaggtatgattgaggctagcttgggaatcacagtcatttctggtaaaagttctttgatgtgaggaatgtcccagtctggtacagttggcaaaagttcactctggggaattttgtgtgtgtgtgtgtgtgtgtgtgtgtgtgtgtgtgtgtgtgtgtgtgtcttgggaaggggtggttgaggaagaagagtgctagtctggtattccttaactccaaaaaggaaatactgcccttgatttattttcacaagttatctgagaaacaaatagcagccttggaaaagttctaggtcttgtttttgttttgttttttcattaaaagggggcccagctgatgaaaacaagttatgaaatgacctatgtttgtgtaactggctggattgcgtaatgctcaggccctgaaaccgtaatagtcaagcagccaggcagggcatatatctgggagatgttttcctaggaaagttaggagagaaaaaacaacagcaaaaagaaaaatccaagaaggggaggtgtgtgcaacggttactgacaaaacaaaatcaccaatgaccaacctttgagattaaaactataactggaacaggaaatatttttcatgcctcaagttcctgccatatataagaacagaggctgtaacaaagactagtctgctccccccacccccaaagtcactggagctcatggccatgtattaagatccagcttcatgaagctagagaggacgggaaagctctgggttgaagaactggcaacaaactaatcaggaatattggacccccaaaagagagagctgaaaaaaataaaattcacttccccagagaaaaaccagagaactgtctcatatggatcggtccactgagatgccataaaagagaaaggcccatccactaattgccaggaaagtcttccagtacaggaagcggagagaaataaagtgattacaggttttatctggtatgtagtaaagttaccttgagcccaagatcgggcaaggtcatagcatagacttgtgaaggaacaaaagcctctgaggtcagtccttaggaccacagaacaattttgttcacacttggagcaatgacagaaaaatccaccagttcctcctcgtcccccacccaaccaccaccacaccaaggagcggacaggccaagaaacttgtctcaagtggcattaccttgccaatccctccggtttgaaaggcgcctcacacactgccgggccgaatgggcaggcgtctatgcgaaaccccgtgcactggttattgctaattgcaaaatactcatgtgttacagcatgctaggaattagccaacagctgctttttgcttcggtaatgaggccctattacactctgctggactgagttctcttccttcttcctagcactggtttcctgtctgattttcttccaaaaccgggaattgcctccgctcacatcctgggctcaaagccctagtgacacagattattcagttggggcactgatgtccggtctgacttccctccaggccccagggtctatgctaaaccaggcagtgagattgtaatactccaatgatcactgctaaagacacattagggaaaagaacagagaagaaatcaaaagatcccttcctgatttcagggaggaggagacagacaggcgtttggggtttgtcgaacgggagacggagggagtgggtacagacttcaacctattccctcattatgtttacattcaacacaaaccactagcggggctgggaagcaaacataatcaacaacttttcggattttaaactcatcaccttggtgctcattacgaagggtgcattgactgcaccctcaatgaacagactaggctgtctctactgtgggtgcttataggagcaccatgggaggcagagggaagacagaaaagccattttggggactcaccaggtatagggaatcactttggaacaagggacccccccatcagatccaaaagagagccacgttccaaaattctttccagctgagtccacccctccctggaagcccaccctagccccttctagaggccaaggccaccgccttatggagcatgagcatcccttgctgcagccaactatgctagactccacagatgctgaccacggtgggcttcatgttgtattgggcctgcgttaacccagctctctctcgagacagagcgggtgggggagctgcagcagagggcagacacgccatcagcacccccccgccaacagcaccttcctggtatttataaacacagagatcacacgcacaatccctccagtgcaaaccagtccggctgctttagaaacaagttgttttctgcttccagaaccacccaggagcctgcgtgatgtctcttcccccacccgaccccctcttccctctgccggtctccttgctccaggtgtggagcagagaaaaggctatacccactgatgaacagggatccacacctggggaagaagcaagtatgactttctctcctgtggctttacacaacctccttgaaattccaagagcaaccctcccagctaaagtcttctcagatgtgacacgatctgcacaagcagaggcggcacagggtttggcttccagttgggaaatgaagctccaagggcagccctactatggcgggctgtgtgacctgggccaagccccttgacatctccagactcggcttccacatctgccaccaccaggacactggattgaatgttgggtacgttgtaaggcaagggagacacagaagtcctaaaggcaataaagcttttccccactgcccctccatctggacgagtctcctgccaagcatcttcaagtcccactttgaaacacgattctgccaccttcctgttctgaggatctgggaaagcaagggggaaggggctattgggagtcccgcttgctccaggcccagaccaggaggctcaggcaggcttatctacttctgatgtggtggggggcccaggatgctgccagggtctcacagccatggtctcacagccactatcagcctgtcctcaagggtataagagaagctggaagcctagatgggcactgccctcaggcaacttccaatccagccaagaagaataaagagtaacacacaaaatattgggggcatgaggcaataactgtgggtacacctataaaaacctctaattgggcttacctggtaccagacagtattttaattggatcatatatagtgcattaattcagttaatattcacaacacccctatgaggtagctacaattattatccccattcgatgatggggaaaactgacatcagaagaggtcaacttgcccaagtttccagagctgaaaagcaacagagctgagatttcactgcaggtattctggccccagagtcttggtacaaatagtgttaatgaacaagtcttcttctggtaagagcaccccaattttcctttggagaacctccacttcctcatttcatgtgccatgggtgaccctacccttgagctcttgaggtgaacacatggacacacgatccagtcctgaccaaacagaatatctcacttccctggctacagttagtgataggttcaggattgtagcaatgacccaagactggcttctgagagtcacatttgagactgtggctcaaactcttagagaagcactcgtttttcaactgagacactacagtctttactactccttgaagacggactaccaggaagaaagccaacctagagggctgcaaagctgagcagtggagaacagcaagttcctgatgacattgtttgatggcctaaaccccattatacttccactggttatctccctggactttcctgttacacagaaattatcccttttgtgttgaagccaatttgaattggatatctgtcacttacaaccaaaaaggtccaaatgtgctagtgaacacagagcacatactgtgagcaactactctttttcttctttctttctttcttttttctgagacagagtctttctctgtcacccaggctggagtgcagtggtgcaatctcggctcactgcaacctctgcctcctgggttcaagtgattctcctgcctcagcctcccgagtagctgggattatagacacgtgccaccacgcccggctaatttttgtattcttagtagagacggggtttcaccatgttggccaggctggtctcgaactcctgaccttgtgatctgcccacctcggcctcctaaagtgctgggattacaggtgtgagccaccgcgcccggcccgagcacctaagcttttcaagacatttccagaaaaacaaatgcaggtaagaaaggatcagtcttcaaagaacttggaagctggtgagggattacaaagattctcaaataactttaaaacaagtcagaacacaattgacagcacaaggcagctacccgggttctctggttaatgcaaagggtgagaattttctatattggatggaacacatcagaaaagttctcacgaaggtggtagcagtgaaattggcctcagaagtctgataggatgttggcaggtgaaggcagggaagctacagggcagacagcatgaggaagggcccaggttcagggaagtatgggcatgcaggggcaagtgtaaattgatgggattgcctgggaccagaggaaaggtctaaaacgtacagtctgaggctggggcggggtggggaaaggatggttctgaggtatctgaagtatctccaaatatctgaagatattccccatggaaaagaaactaggcttatttggagtgaccccagaggacaagactacgactaaaaatggacgctcgcaaatggaggaagtagacctgacccctgactaaggaagatggtgctacctgtttggggcaaatgttcaaaaagaggctgtgtctgtatggtggatgctgttaaaagggactcagaaaccaaatgagagtctgaattagctgagtttaacattctgtgagttttgtgccagacttgggactactgcagaagaccctgggagagttgggattgaattccaaaggcagtgctgatggacactgacttgaggagccaggaaagaaggcaggaacagtggtggggatcacagcctcacctgtatctgtgcacttctataaattcacagactgggaatttttaatgtgaactggatattagatgatgaccaggaattgttttaattctgttaggtgggataataccattcactgtgctgtgtaagataatgtccatattgtttagagatgcatactgaagaatataggatgaaatgacataatgtttggattttttattttaaatatttcagcaaaatgtggggacaaattttatatacattattttttcacacatatgtggtattcatatatacacaaatgtatatattacacacatgtatatgtacatacatatatgggtgtatatctatgtgggtatgtgtatatgctacatgcatgtgcatagctggttagcaaatagaatagttaacaaaataagccagacacaagataatacatattgttccattatatacttttttttttttttttgagacggagtctagctctgtcacccagctggagtgcagtggcacaatcttggctcactgcaacctccacctcccggattcacaagcgattctcctgcctcagcctcccaagtagctgggattacaggcccctgccaccatgcctggctaatttttgtatttttagtacagacagagtttcactgtgttggccaggctggtctcaaactcctgacctcgtgatccgcccgcctcggcctcccaaagtgctggaattacaagcatgagccacgtgcctggcctatatacatttttttaaggcaaatgaatctatgatggtagaagtcagggcatggttggccttgtagggtcaggggaaggcagagacgagaggggtccaagggcctctggtgctggctgagtgctgtttctaggctgagtaatgtgtgcacaggcctgctggctctgtgcaaactcattgagctgtgcacatgatttgtgtaccttatgtatgttttagacttcaataaattcactccaaaataccaccccctacacacaaacacacagacacagacacacagacacacacacacacagacacacacacacacacacacacacacacacacacacacacacacacggggagagatctgaagtaagtaggattcctccattgatcatttcttgagaagcggggagaagacatgctctgggctatgctttaagcaagagttttccaaacaaatttgctactttccagagtgagatgtttttttcccatgacccatggggcatatgtcatgggctgcagcctgaagttgaaaagtctggttttaagctgatctctctggtggcagggtaaagaatggaaggcaacaggaagagcccagagaggaggctggcagcttgtgtcttctgccatggttcaggagagaggtagggagactctgtagcagggccaggtgacaggaaggcaagtgtgcttcagagaaagagtccagcttcattgtgtgggcaggccctgccactccagctgcctggggtatgctcagagggacaggggaggcctgcacagactcagccagacaccccaaggacaacacacgcagagtgcaaccaggtgct

SEQ ID NO: 5854 - DNA, 2034 bp, Homo sapiens
tttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacgatgacctggaaggagatgtttcgacaacttggcacagtaacaatgacgatgtgtatagggtgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggatgttgctgatcaagcacaggataaagacagggatgatcgttcttttggccgtgatagaaatcgggattctgacaaaacagatacggactggagggcttgtcctgctacagacagctttgatgactagaagaggtgatgatagctttggagacaagtatcgggatcgttatgattcagaccggtatcgggatgggtatcgggatggcccacgccgggatatggatggatatggtggccgggatcgctatgatgaccaaggcagcagagactatgatagaggctatgattcccggataggcagtggcagaagagcatttggcagcgggtatcgcagggatgatgactacagaggaggcggggaccgctatgaagactgatatgacagacgggatgatcggtcgtggagctccagagatgattactctcgggatgattataggtgtgatgatagacgtcccccccaaagacccaaactgaatctaaagccttggagtactcttaagcaagatgattcctctgctagtacctcccagtccactcgagctgcttctatctttggaggggcaaagcctgttgacacagctgctagagaaagagaagtagaagaacggctacagaaggaacaagagaagttgcagcgtcagctgagtgagccaaaactagaacgacggcctcgggagagacacccaagctggcgaagtgaagaaactcaggaacgggaacggtcaaggacaggaagtgagtcatcgcagactgggacctccaccacatctggcagaaatgcacgaaggagagagagtaagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacgcagagcagcaatcccctacaagtggtgggggaaaagtagctccagctcaaccatctgaggaaggaccagcaaggcaagatgaaaataaagtagatgggatgaatgtcccaaaaggccaaactgggaactctagccgtggtccaggagacggagggaacaaagaccactggaaggagtcagataggaaagatggcaaaaaggatcaagactccagatctgcacctgagccaaagaaacctgaggaaaatccagcttccaagttcagttctgcaagcaactatgctgctctctcttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagatctttcttacctttttttaaaaacaaaaaatgaaactattttgcatgctgctgcagcctttaaagtattgaagtaactggag

SEQ ID NO: 5855 - DNA, 4234 bp, Homo sapiens
actgaggaagaatataagttagcctcgtagtgaccatgtggaagtcctgacctcgcttgcagacttgacctctggatgtgacaaggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcaggtaaacttgttacaaaatttagtcttcgataaattagtctctgcaaatgatttaccattgctctacattagtaagctgaatgtttcactaacaaataagaaaataaaatatttcatgtttttacagctaacaacttagtaatacctactcagagtacatacttctttatgtacccatatgaacatacaatgctatggaatgtaaagaagtatgtatttttggtaggcaataaaccaccaagggagaattaaactgagctaaaagaagctcttgcttctttctacgtgaatgaccgtcatatggtaaattaacctagtcatgaacagatgacctttggcaatactaacaccaaaaaaaaaaggttatctactactgatagatagaaactatccctaaggtttttatttcatgaaggaaaagaagatccagtgaagtagatttcaattatcatgaaactccttttaaatcatctaagtttaaaacagacatcttacatttttaaattaggcactctcattattaaaatttgactgcaaaagggaaaatagtattactagcacaaaagaatgaggaatacacatgacctattttctgtctccacaatttaatcttaagtatatctcattagtagggctcactgatttgtacagaaaaataagatactaagagctggcttcattcacataataagctatttcttctcattttgataaatgtataattaatattagaggaatttctgaccaaaagttttgttgttttaaaaaggctttcttttttgacagctacaaacatagtggcccttgtccttccttctcaagtttatcagggtcttaacccaaatctctactttaaatgtgaagttaaaacttaaaattaattaaaatgtaagatttaagcatgaaaaatgacaaaattctggtccacagctgtaagtcagcagggtatattggtaacagactaccaaatatttaaaagaaattaatttatctgtattatcttcgaatttgctttctccaaagagggcatgtaaaatgaaagcactatagtcaagaaccaatttatacagatcgaagaactgtttttattgtactatgcaattacaattcaatttctctaaacttgatcaatccattgtttagaaatatcaaaatacttttatttcacacagtttgtatattatttataaaaaattccaaataatgctcttagcaaaatttataagcagtacctgttttaagctactaatgacaaagttagaaaataagagtaatattcacatattctaaccatttcttactaaaagtattatttcaactgaaatatttacacatgtataaaagcataatattttaaattttttgtatcagaaattgaatggaaatgactaagtttaactatagttcattttctgtttaataagactagttaatacaaagatgattttcattttatcagattataaagaatgagaatgacttacacatggcatcatatgtgttactgcatgtttactggaaattataaaaggcacataattttaaaattctacactttcaaagaaattagttcaaagcttaactcacataagcatagcccttctgatcatccacaaaacagaatggcaatgattcatgttctatttggtaagtttacctgtataggtcctaaataccaagaactcaaaatatatacctcaaaagtagaggttcttctataaaaatactcaaagcttattactctacttgtgttttataataaacagttatattggtcattctataggtatacaagttgtttaataatccttctcaaacatcctagcaactaagactctctttgctataatattaagactatataaataatccttagaaaataaaatgacaggctattcatttttaaaagtaaaattatatgctgattctggtgcttgcgagtttaacttatctaagagtattttcaatcactctaaaatgtcacatctatcacttagatcagctgttcatttttaactgagtacatattaaactctgggcatctgctgacactggtataactcaaacatttcaactgtctccctgacagggataacagatgctgacattatcaaatgctgtactatttttttcccatggcctctccttgccccgatatggccagtatatgaaactgaactgccatccaaaaacacacttgagcaactggatctgctaaacagctcccatataactagtaaaaatagaagccagtattattgctatcttcagcacttaagtttaggcagtttaacacctgtttcacttctactagaaaaaatgatgaaaaagaattgtagttaatttcaccagcagtatgatacttaccaaccaacagacgcagaatatacttagtgtaagagtcatttgcatactgcctgaattagcgttgacctctcagtttaaaatagtaactgtaaagaatatttctctactctatatttctctgagagcacttaactttataggcaaattataatttatcaaacttttattttatgcaagaagacacccctctcaagacattgaaatcaacagtaaaaccacattataacaaaaatttactctgatttttcaagtattatccacacaatagattttaatacttgtatccatggattgtaactaaccaccatgtattactaaggcgataatgagaagtaacttggcaatctgtacccaaaatgacaaagaacttagtcaaggaaatagacctttaaaagggttaaattactaagctatgattagtaacaccacgtaagcaaaaacaaagaaaaactggcatgcatggtagttcctttcgacacaagtccaagcaatacactgaatacacatgtgatctatttataaatcaaagggcagaggtactttcttaaggccactgatattcctacacccatcaacaatttgctattagccctcaactataatgctaaaagaagcagtggcagtagaagggggtgactaactgaactcttccccaaccttttagcttaactatttatctggtttgctgcctagagataaatggaaaacattactctaaaatacatcaaggtctatttgttcctttaaatactattggttttgaaatagcttattgtctacatgtaagaattaagcaaagacttcggctgtggacaagattagaaaaagaaaaagaagcaaagatgttgaaaacaaagacgtacattgatcattccttaatgcagtaatgtgttaaaaggaaaagatttttaaaccattaagcgcaggaaaacagtaggaaagtgacttcaaaatggaaaatttgacattcagtgactgaagcattggtatgataatttctaacacttgtagaaggtccatgactgtaattttaccaatgaaaagcatttaactgttttggattccaaactagcagcactacaatgctttgctagagctggtaaaatggaaccaaatcgcctcttcaatggatttggtccccttcaaccagctgtagctatgcattgattactacgggacaaccaacgttttcatttgtgaatatcaattacttgccaactaatttcaacttatttacattatgcagactgtgattataatcaaataacttgttactgttaattctacctggaaaagctagaatggttaaagatgtttataaaaagctttatgaaaaatgtatggatgacttaaggatttcaaataaaaattttacttattatggtc

SEQ ID NO: 5856 - DNA, 4556 bp, Homo sapiens
agaataggaaaagacacaatttcaaaataaagatcaaccattgaaattggataaatttagccttatgaaatactcaaacaatttttttttccccgtttctctgaggacctacagatgcaggtattgttttgcaaaccagctttgagaatcactgatttgtggtattatgcatgtatcctttgatgttgatactattaacaaatgagcatcatatccttaatcttgcaataagattgcgattagagtctaaacatgataaacgaaaaattaaagtaggccgtgtgtcatttctggcctagagatacttcatttgtttcttttttttttttttgtttttaaatagtaataatttaacataagcagaaatagtccaggctctgcagtatctattctatagaaagtacttataataaaagtgatatacattaatactataatataaaggcaaatactaaatgaatttaataataagagtggtattttggagtgaaaaaggccactaaatgggggaagttgatctttaattctatttattaaataacaggatgaccttgataaataatgctgttttctcattggtgacatactattagactaagtagttcactttatatttaatcagccattatcctgagtattattagtgtgaataagaaatacttgttagaacattgggcagtggtaatcaaaatgaatttcgaagtggaattgtagtaatggttgccttaccttgagtaatgataaggacaatatttctgtaatggattgtttattcatgaaagatgaaagattaaaatggtctgtctctactgatgaaagtaacagaaggcagcctcaaagtttatttttatttttatttttttagagacatagtcttgctttgtcacctagcagagaggcttggggagcgcaggaaagctataaatcccaatacccattatctcctgaggacagacagtctccggtgcaggcagatgcttcaggagttccccataatctgtaggatggaagctgagtgccttaatatggcagaggccctctggatgtggcttctgccttctctgttgatcgctttcttctcactcgcctgtcaccgagccttgtttgttcgtcttaaaacattttggaaaaagttgaagctctccttttctaccctcctgattctgtgcttctgttggagtgcatatcacttgatggcttctaagacaaatgctaaattcttgtcagattacgcagtcatcacttctttgccttttttttcagccatttcatttgcttgtctctgtctttgcagaaattttatgtttagaattacagggacaggaagaataagaataatttttatgacttggggtcaaagaaccattgggatgtgcttttctgggaagaacacctttctcgtgtcttcatggttatcaaatcaatatttaagataagaaatacaattcttgtggtcccttgataagagggttgcctcaataacagtaaattagattaccttggggggatttattttttaataagccatattgatttttacccaaaattcattatctaggagtttacaaagaaattcttcagtatgtttcaggattttcccatttttgaagttgaagtaatatattttttcttttctagattttaagtttgttttaaagctgggctattctcctttaattttcaaggataattgttagttgtgttgtgaccacttaggcttagtgcagtaggatgaacgaaacaagtgcctgtggatgaatttattcagcattcttcattgagatattctttgggataacttcttatctttataatgccagatgctgatttcattagcacctggttttgagagattacctgaagttgcactcaaaagcaagatatactactaactttgaaatggaataaggttttttgtatttttagtagagatgaggtttcgccatgttggctaggcttgtcttgagctcttgacctcagatgatcggcctgcctcggcttcccaaagtgttagaattacaggcgtgagccaccatgcccggatgtattaatggtattttaataataactcttggttgataaacttaaacatgacagttttgagcaggcaccttaagttctgtatactaccgtgaggccaggcacttgtttagcttctgtgtcatacagctaccccttgtattttgttctttttttttttagtataataaatctatagttttattaacacagaaactgatagtgtggtatgaggtttacgtttaaacaaagttttcacagaaatctaacacatgcctaaaaagattttacaatctagctctagatgcaagtccagacaatatcaagaactgataacataagagagcagctgcccatgccaaatagttacctcttttaaactcattctactggagcaaatgggttttttgatttgatttaactaatgtggttttagctgaagagagcctttccaagagctcacctgtggtaccctgaggaggagttgagctgtcatcactctaacccaggaagacctcatggagaggagggcaacacaaaggatggctagtttctcagatgaatttctgtttcagcaactggcttctcaggcttcattgaactcaaaattaaacccaagcctctttttatactgttaagaaatgtgctgcagacaggagggggaaagtcagtattcatgaattttcaagttggaataaagaagacatttctgaaatgggctgaaataagtggaattggggaaagctgaagatgttttgcattaatgtgttatgtttcccttgaactgtagccaagagactcttcataacagcctgcatttcaagtctaattgtaagccgggtgttgtacctgcctgtagtcctagcaactcaggaggctgaggcaggaggattgtttaaacccaggagttatactaggggagaggctgttgtttatttttggcagagcaaacgaacacagtgaggactactgggagactcacttgaagacaggcggattgcatctaagaggtggtgttgcccacactgcaaattgtgcttgtgtctgtctaaacagcaatgaaaactggccaggttcatagtaccctttcaaagtggagttctctaaggaaacattagcttcagttgataactctcaaagaaactaggacagttcccaggctgctctgtatttgtgtagataaacaacaggcattaatagagccatactgaaaaaaaaaaaaaaaacagtaataaaattcactgtgttctaattgtgtcctcatagcagcgttatattttttaaccccaaaatggtacctaaagtggagatttgtatgcattatgaactaaatacattttcttaagtagtatttattgtgtttagggtttgccactatttctgactaaaatggatgttcatggtctcaagcacattgaccagttatcttttaataaactattttttattgtgcacagaaccaatgtaatggcattagttacttgttctttcagtttattttgataacaattttctcttccatagtagttctctccatttaattgaatttgggaattactgtcgctggggagttctgtgagccaacattgtatgtgtgtggatatttacaaatgcaccgttggattctttgtcgttcaagtgaatgttgactatttacagcttaccaatccgcagagtccactggagtctcacctccaagataacttccccaacctctctgagaccttacccatccgcagagtccactggagtctcacctccaagataacttccccagccacctaaaccaagccccagcatccccagcatcactctagtgcttagttattattcggggatgaggtgaggggttgctagatccacatgaaaactctacatgctgtgaagtgcagtacagatgtgagagggcaacactgttttccttgcattattatttttgttttacctgttatgtgtttgtcctgtcatccccttcccccacattatgaccctcctagaggtcaaaagctttatgtttcttaacccatccccaagtgcaaaaaataaaaaaaaatcaaagcagtatagagctggaatgaatgagtgagtgaacagaatgatgctctctctgctcccaacttatattcgtttaaaaatagacattgcctttagaaaactgacctttggtacatttggggcctagggatctgataggctatctcttatgatgcacatcgctctgttttagactctgaaaggcagtatgcctttgaagctagataacgtcagtgtgcttgtaacttgggacccagtctgtgtgctatatgtctgcttcttcagtccacactcattacttccaggaaattcgtgagaagatgagagattattcgttatagaattgagtatggtttctctacactaattttattggatattttccagtttgactaggaaaggttagagaacatggaaagaaaatttaacaggttaattttaaggtaataagaccattgtattgatatattcttcagtgtgatttaggtgagtcaggaattttt

SEQ ID NO: 5857 - DNA, 2039 bp, Homo sapiens
tcagactcccaaagtgctggggttacagacgtgagccaccgcacctagctcagtgacacaatcttgatctagtgtttcattcacttaattcaagacaaaggaggcctttgctggaaaatgcatcttttctgcttttaccctacatagttcacagacactctctgcagttactaaacggggtggcctgagtaatcctgatctttaagcaaggatcttttctaaactctgagtggtatgggtaagaaaaagaaaagaaatatctcggtcttctgcagtgaaattgatttttctaatgctcctggaaatactgttttagagtagaaaaataagtggagccaggcactagaatcataggaaaatactttttccaaattgagaagggaacatacgtacatacataaatttggtaaccaaaatgcattttttcttttttcttttaatctaccatttgaaatctaaaatactgtgataaaaactgtcaaaagtgaaaatttgtttatgaaaggtatattgtttaatacatcctctactatagagtgatcagaagcaaaagaagtaaattaatgaaacatcaagaccccactcatctcagcactaagtctgtcagcaccaccatccttcctaaaggaaataaattaaacttgattccttaaggtactacaggaatcagagacaaaagtggaaagaacaaattaaggttggagagaaattttcagtttaaagtttatagatatgaagaaaattcttattttacccattaagaacaaatacagaagtgaaattttcttactggtagtcagtggtcagatatagctacattttccccttaagtcataccacccaactctagcttccaaaaaatgttgaaaactatcattcagcatattctgagacattctagtgtcttcatagtggtatacctgttgtaacactggcaacttttataggtatggaggacaaagcattccaacaaattttcatggtggagagaaaaaggcctactttcttattttgttacagaagccagaaactcttaaaaaaaactaacattgctgccaaatacaatttccacacaactccatctgtggtattgacttagctggtaaactttttattatttaaagaaaaaaaattacatatataaaatgataaatatttttaatgatactttaatatggtttttcctcagttatgtttaaagtcctaccatagtgttaagcagtagccttgactttgaacctaaaatagaaatacaagtaagaaaaattatgagttgaaaattagcttcttggactttgtgtttctcattccttaccatttttcactagtacatctatccaaatcacaacacgtttctttttaatgagatttaataaaaaatgtttattgtggcacaaattcaatgagcaagatactcttcaaaaggaaatataattttatttagttcagattctaaaacttgtactttgtttaactttatgtatcttttcattggaaatacctttttgttattctttgttgacattgaaatcactttattaaataaaagcctactgcagtagcacatgcctgtagttcgagctactcgggagtctgaggcaggaagactgcttgagtgcaggagttcaagaccagccagggcaatgtagcaagactttgtctctaaaataacaataataaactcagcaattaagattagttgacattggaccacttacagaatatttttttcaaattagccctactacttgtaggttcctcccagtcttaagactaaatacctttttaatttggggtaaatgtcagaattggaagagactttaaagggcatgaagaattctactccaaaggttatccagtccacgtacccatccagcctatcaagtgtaaatcctttctgtactttaaattcttatgagacacaaactgcctcctaaggtagcatattctggttttggagagctctacctactagctggttatttcttacattaaattaatacctttaaaaagtattatgaaaataacacactcagtaa

SEQ ID NO: 5858 - DNA, 1772 bp, Homo sapiens
tgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaactggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgctctagcatgcttatagaaaatgtcagtgtttcttacagctcaaatttgtatagttgttttaaaatgcggtctctttcttcccctggtacttttttctttctgtctactgaagttagttcttatacatggtcttatattttggctgtctttttttccctaggaacattcatacaggttgaatattccttatctgaaatacttgggactggaagtgtttttgattttggagtttggaatacttttttttttttggagatagtgttttactcttgttgcccaggctggagtgcaatggcgcaatcttggctcgctgcaacctccgcctcccgggtacaagcgattctcctgtttcagcctcccaagtagctcggattacaggcatgcgccaccacgcctggctaatttttttgtatttagtagagatgggttttcaccatgttagccaggctggttgtgaactcctgacctcaggtgatccacctgccttggcctcccaaaatgccgggattacaggtgggcaccaccatgcccagccggattttggaatattttcataacacttactggtgagcacccctaatctgaaaatcctaaatctaaaatgctccaaaatttgaaactttttgagcaccagtatgatgccccaagtggaaaatcccacacccgacctcatgtgatgagtccaaactgttgtatgcacaaaattatttaaaatattgcataaaatgaccttcaggctatgaatagaaggcgtctatgaaatataagtgaatttcgtgtttagacttgggtcgcgtcccccacatatctcattttatatatgtgcaagtattctcaaatccaaacatatacagagtctgaaacacttctggtcccaagcattttgaataagggatactcaacctgtagtctttcttttaggaggggggaaaaaaaaagctttttttttttttggagacagagtcatgctgttgtcacctgggctggagtgcagtggtgcaatctcggctcactgccacctctgcctcccgggttccagcaattctcctgcctcagcctcccgagtagctgagattacagacacctgccactacgacgggctaatttttgtatttttagtagagacttggtttcaccatgtt

SEQ ID NO: 5859 - DNA, 4600 bp, Homo sapiens
gccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatatagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgacacggcgattccggctcttgttttgggggtctttccccgaaatggtttccgtcttccccttgccccgcagcgacccagagcgctgggggaagcggagtggggagaggcagaggcggtctcggcagccaatcagcgcctgatgtgtcctgtcgggcgcgtcgtggttggctggcgatgacctcatcctgcagcagcgggtggggccaaagccgtagggggaggctgttgcaaaggtagagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaaggttcctgcatcatcatgaaatttgaagcacttttatagtagtacaaactatacttttagcttttgaaatctcgataggagaaaatatccagcagttttaggggctattttggcatattcattaaggtagactaagtttgtttttcgtttttcccacttagccaaactagttaaagtagtcaaaactagcaaataatttttaaagggcttctccttttgggtggtgtagagggtggggagttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaactgaatgtggatgagctataaatatttagtacaaagaatgtaatttgtccactctgaatagaaagtaagcattaagaactcttgaatgtcttcaagggttactttgttacgtgtaagatgtctccccttccttcatagcagtttttattcctgcttaaaaagggaactaaatatgaagtcagtagattttaaggtaattttcagaatgtttctactttcaccgtgccttaataaggaaaaaaggccattttccaagcgaatggaaacaccctttccttgttttgtgcctttaatcagcgtgtaccttcattgttcctgattgccaaatccacgaacttcttgagctctcaatttttcttgactttcctatggcattttaaatactgttcatacttggaattacttttctttgactgccttcatacattcatatattctgcctgggcaatttcatttgggcctattatgttccaatacctctccaattttcacctccatcttagctctgccagcttcagtgccacaggtaggcaatgtaaaagtttactggggaccacaggctttctgagctcaataaaaatactaagcttggtacttgttttttaagaattttcttcccccatcccctcacaaagattatttgagtaaattacaccccaacctccttttccttgtttttgttgaaattattgtctcttaactttggaacattgcagttgcggtaagcttactaggttcacatagcatatcttctggtgtgttaaaattaaaatgcacaccatctcaaaagtgctatgccatttcatacctttgtgcttttgtcctgctacctggagtgcgtctttctcacttctggataatacaatttgaaccttttctttgcctcttgaaactgcaaaatccctactcgcaagtaaatgtgtcattctttatgttgataacccagcctagtgcttgacacttgatgggcattcaggtatacatggttttttagagattgataagattaactgtgcagtctataaactgtaaatactggcttttaaactcttttaaaggagctcttttgataaacaatttggataagagatgaaaggttagggaggctccaggcaaggcagaagactgctgatggcccagagatagttctgccccaaaaaggtgggaagaagaaaaaaactgagctggatatttttaaggaaatatattttatagcatttttctttaatgcctagttttgctgcaagcactgaagtttatcctgcatttgtatttcttatttgaaaaagaaatggcctttggggtttgttttgttttttgttcctttgtaagcacactgcaaaagcggcgttgtcagcgttgtcttttgaggtatcaaacgtgctttcagtcagcaaatatcttgtatatagtaccattcctaataaactaaattggttatcaacctaatacaaacggtacttcatacaacttaagcctaaactagattagattatgtagaaacttattcttagagaatatatcgccttaatatttcttatcctgaaaagagtatttcttaagtgcccctctcaaagtatatcgattaatatttgtctcaaatttaaaactatatcctggtttttcccttacagttgtttagcaagtaaatgtttacttactaatttattttctcccagacttcattctaccagtttaagcttagctcagttttgttttttggttttgagaaggagctttgctctgtcactcaggctggagtgcagtggtacgttctcagctcactgcagcctccggctcctgggttcaagcgattctcctgcttcagtccgtgagtagctggaactacaggcgcacaccaccacgcccagcta

SEQ ID NO: 5860 - DNA, 1316 bp, Homo sapiens
tcatcccatggaggaccctcccttcactccactcacttagaggctgttctcacgttgatatccaagtcacccttgaacacaaactgaccaggtttccaatgaaaagacaggtggctccactcccagtgcatattttcagttgtgttgtatggatcctatgaccacccccgagaatttggtgagatatagaagggtctcagctcacctcccatttcacccatcacaaacgtccctcagccaaaccaactgcctcatctctactcacagtgaaagtcatggtagaatttgagtgggggcatgttcctctccactgccacgttaccccacggaagccccaagtgcaagatctgacgccgacgggagcaaggctgaccactctgctcggtgcccacaagtcgacccattagccgccagtcacggatctcaaacagcctcatctagagttcgagaaaagtcatactgataaggaaactccaccgagactgagccgaaagagaggagccaaacacggttccggagggtctgcagcgcagggaaggggttccggtggaggatcatctcttccagctcaggtagcagctgcacctccacctccttgaagttgaagatactattgccatcaaagccagcagccagctctggacagtatgcctgcagggaacctccatgccggctcagtgacacactctctgcagccagggtaatgaacttgtcctcagctacaaaagctgtgagcttggctgtgctcacctccagggttaggtttagcagccgctttgggggtaatggctcaggggcacggccttctagctcagaagtagttcctgaagtctctagtgcaagggatggtacagtctcaggaaacacagtggctcttagtaggtctcggcactgtagagtggccaggacatgctggtacaggtacatgtgatctggggggctccaaagtaaggtcagccctgcaccacactgaacctttagggagcagaagaaaaggatctgtcaattaccatgtcacaaaacagtagagatggcaaggattatgacacatgcacacctggctcaagaaccatctccacccagaagttgttcctgagtaatcacattaattactgccttgctttgttcctgttagcactaatgtgctgagctgacagttgatagtgtctgacatttaagagcacttatactttttaagttctcttcaactggattctaaattgtctgaaaataggggccatgtgtcttaattctttggtatctaccatagtatactcagtatagacagcaggtactcaataaatcatctggcttca

SEQ ID NO: 5861 - DNA, 6391 bp, Homo sapiens
gcctccgttctctgcatccctccaccccagtatccctgcacctcttcatccctccattcctgcatccctctatttttccatccctccattcctgtatccctgtgccctccatcctccatcccagcatccctccatccctgctccccactctcacttcccttcccttcacagacaggcttttcctgccatcctcagaccccacccagggttacctgatgcctttccagctgcacacggggactgactcacctctctctttctcagtcccaaagtcccgaaagagagcatctgatgtggtcagcttgtgacaaggcgtccaccttctgtccatgacatggaggccaggggaaggtctcactgcccagcaccccaccctgtgctcccaggccttttgaatgttcctcctgctcagcccagtgactgcgggctgtggctcctcctccagcctcccctcgaggtcctggtcttacttaggaggccccgggtgtagatgccttcccacccaccaggcattgccccttttcctggcttcacagactcgggaataaagtttccttctgtttcccctcttgcagaaggagatccggttggcagctaaaccgcgctgggaacaggggcctgagtcctggactagggctctttccccggggctgctgcagatggggaggagcctacacccgcctcccgagtgctaatcagacctgacaggctggagaatggccagtcagcctgaggccaccgcgggacaccacctaggcccagcttctccccccaccagagggcgccagagcccgccaagcctcgtaggagatggcaacagggcctgctgctgccacctagcggccaattccgggaatgaatctcggcacgctcattacccagcgactctgcccatcttgaccctttatgtgaagcagaacagccgcttccgcagtgagctgtcagaaggcgtcgtgcctgtcttgctagtggggaaactgaggctcagagaggcagaagacttgcccaagatcacaccaccgggacccaggattcaagcgcaggcctgcccaggctctctgtggcctcctggctgcgaggaggcagccagggaccaggtgccacccttctgagacacctgagatcccaggcccgagaggatgaaggcgggattacctggagcgtgtctgaatgctggaggaagaagggcagctgggagatgaagctgtcaggatgggccgcatcccatttcctgcctcgtttcagttcaactttccaacagacctccctggctcgtcttgctcttctctaatggacaaacaaacaggctcagagaggtggtgtgacttgcccaaggtcactcagcttggatgctatggaacagggacgtccactgtcccagtctgtttatgggaagccgctctgcaactgtcctgacccaccacatgccccaccgctgtttctcttgccctgaccccttgttccctggaccagggtggcacagctccaggctcttgggcccttcccgagggcaggcacctgtgactgtgtccccaaagacctgagtggctgagggggccccacagagcttggacttcctggaggacaaggaggggtctgccagccacccccaccacgcccgccccagggctcccctggagcttccatgccagccggactcaggtgggtctggaggagcaccgtgcctccaatcagaccttgagatgtgccccctgcccccactgtgccctcccctgcccaggagtctggttgcaaaccctgattaaggggattttatctccaccagagggccagtaggtgggaagtagcttaaacaatgcaggtttataatctcacagttctggaggtcaagagtctgaaatgggcctcatggggctaaaaccaaggtgtctgcagggctgtgttccttctggaggctccagggcaggaaggggaggatccacttctgtgcctttccagcttctagaggctgcctgcgttccttggctcgtggccccttcctccaccttcaagccagcagcggaggcctgagtccttctcatgccatctctctgttctctctcctgcctcctcctccacactgaaggacccctgtgatcacactggcccccccaccggatgacccaggataatccatctccctgtttgaaggtcggctgattagcaaccttcattccatctgcctccttcattccccctggccatgtaatgggattcacagcttctggggattaggacatggacatcttgtggcgggggcataattctgtcgacgacaccaagaaacacttggatgttaaggattcaccgaacactgttcaggctgaggcaggagaattgcttgaacctgggaggcagaggttgcagtgagccgagatcataccattgcactccagcctgggcaacaagagtgaacctccatcacaaaaaacaaacaacaaaaaaaatcaggtataattacatacagtgaaacatatggtgactcaagtacacagttcagtgttttttttgtttttgtttttttttaagatggactcttgctctgtcgcccaggctggagttcagtggcgcgatcttggctcactgcaacctctgtcttccaggttcaagcaattctgcctcagcctcccaagtagctgggactacaagtgcacgccaccatgcctggctaatttttgtatttttaatagagatggggtttttttttctttctttttttttttttttgagacagggtctcactctgtcacccaggctggagtgcagtgtcacaatctcggctcactgcaacctctgcctcttgggttcaagcaattcttctgcctcagcctcctgagtagctggtagctgggactataggcacgtgccaccacacccagttaattttttgtatttttagtagagatggggtttcaccgggttagccaggatggtctcaatctcttgacctcgtgatctgcccgttttggtctcccaaagtgatgggattacaggcgtgagccaccgcgccaggctgagatggggtttcaccacgttggccaggctggtctggaactcctgacctcaggtgatccgcctgccttggactcccaaagtgctgggattacagacgtgagccaccgtgcccggccagttctatgagttttgatgaatgtgtcctgcttcttcccaggctccaccatctcttcccctaaaggcaaccaccattctgatttctctcaccaaagactggaaaaatatcccaatacctggatgtatgcctcacgtgtcccgctggccccagcacccaggtatagttagttactgctgtgcctggcttcactctcactttttttttttttttctttttttgagacatagtctcgctctgtagcccaggctggagtgcagtgtggcacaatctcagctcactgcaaccttcacctcccaggttcaagcgattctcctgcctcagcctctcgagtagctgcgactacaggtgcccaccaccacacctggctaatttttgtatttttagtagagatggggtttcaccttgttggccaggctggtctcgaactcctgacctcaagtgatccacctgcctcagcctcccaaggtgctgggattgcaggccggccttacctggtatggtttttaggttcatgttgatgcctggagtttcagtaattccctcccattcgttgctgagtagcactgcaacacatgcaggcagctatttggggatcttttcacctgttgatgggtgtctggactgtttccagtttttggctgttacaaatgaagcctctgtgagccacgtacaagttcttctgtggatgttttcatttagggaaaggggtaaataggagtggaagtgctgggtcacagggcaaatgtccatttgagtttattagaaacaattctccaaaatgattggcattttaccttgtactagcagagtctaggagtgtggctgctcccagattctcatcaaactacagtgctgacatctttagttctaggccttctagtgtggatgcactggtatcttgttaaatgcttttaactgttttggtagagatggggccttgctgtattgcatagtctggtcttgaacacctggcctcaagtgatctccagcctcaccctcccgaagtgctgggattacaggtgtgagccactgctctgggcctcattcagtgttttgcttctccctgacaactaatggagttaagctcgttttcatgtttattggccattaagtcatcttgcttttggaagtgccaattgttaactggcttgtcctcttctttttgccttacacagttaatacatgctggagattacatgtactgcaaagattttctcctagccggtgacttgtctttttcgtttttgtttctgtttttttttttttctttttttttcttttctttttttctgagatggagtctcctcgctctatcgcccaggctggagtgcagtggcatgatctcagctcactgaaaccactgcctcccgggttcacgtgattgtcctgtctcagcctcccgagtagctgggattacaggcatgcgccaccaagcacagctaatttttgtatttttagtagagatggggttttgccatgttggccaggctggtcttaaactcctgacctcaggtgatccgcccacctcggtctcccaaagtgctgggattacaggcgtgagccaccgcgcctgcccagcttatctattcattggaggatctgagtgacatgagaaacttaggttttctttttttgagacagagtcttactctgtcgcccaggctggagtgcagtggcatgatctcggctcaccacaacctctgcctcctgggttcaagccattctcctgcctcagcctctggagtagctgggattataggcacctgtcatcacacctggctatccacttaggttttcaaagggccccttggtcttggggtggagagtgaagggaagcagggggaagaagtttaggtcttgcaatcatccaggtgagacatgatattgtctttgatcagtggcaggggtggaggtcgggagaagcggccagagagcagatctattttgcgggtggggctgacggtatttgctggtggactgccctggaaccagagggaagtacagagtcaggttgactacaaggtgtttggcttaagttcgtagaagaaaggagttgccatttgctggcatgaggaaaatgaagaagcagattttgggaggaaaatgaagggttcggcttctgacatgctgaactcgaggtgctgtttaagtggatgtggatttcacagttgtactgatgaagctggaattcgttcaagtatcaaaggagtgtcatctaaatatagatattgaaggtaatcctcagtcagatgaggttactgagagggtgtgaggaggcaggagcggggtgaggctgggaggggcagctggggggaggggagagaagcccagcgacgtcctcggtgtctgtgaagatggcacttccggcggagggagagatcccccgcaccctgcctgagacaggctgaggaacgaccctacacagcaactcagggcaccccaaatcgaacacgcaaccattaaagagggagcgcctctaagaagccgaaagggggcaccaccaggctccagaggggaaaacagggcgcattttctaacatgtcagcacccccagaccacccaggcccccgtcagaaaaatactggctccatgatcagctttgaaacaactttattagaaggctgctttaaatgacaacttctaacgtccaattctttcttaatttgctttttgacgactccagttatatgttcatatataacaatttttgcattgatctttgcatcctattgaagatttcctcatcaggtcattctggtggaatggaagtgcaaccgtgaggtcgccagttggccggcattgttaagcaagggcagcagaaggctgggagggacggagccagtcccccaccctctcctccagcccccgcccaccacaaattcacagtgagaggcacctcactgccttgacattcagaaaagagtgaaataaagaaaccctcgcagcgcaggaaataactggattccaccttcaaggttattgaggttcctccctctctctccacgcccccagtcaaaccctgaaatcctaaggctgggggcaagcccttccccaacctgccaaaggaaaggagccagggctgctgccttctggccgcttttctgcctccagtcccaaaaggaatttctctggacagatgtgactgcagcggcccaaggccccccttctcctcctcctcccatcccactgggcgggcttgggaaggtacaatcaaccatgaacataaatatgaataaaaaatgaacttgaaaatgacaa

SEQ ID NO: 5862 - DNA, 5052 bp, Homo sapiens
ccgggtcccaccggctcctccggaagccgcggaccggcctggccctgaccccaggccgccccccgctgcccacccagctctgggcgcccaggtccgacctcccagtcgccctctgagagccgagtcagcgcggggcggggggtcgccccctttgtcctcactcagggcgggaggccctcggggtggccgcagacgccccgttgggcagccctccagcccagctctccaggcaggaggtgggggaagcctgggaaagcggagggggggccccgggatcccccgaggcgcggggctcccggcgaagcctcagatctccggcccttcccggggagggtgcgggcggggcgggcctttggaaatgcagatgagccgccgcccgggccggggttgaaccttctgactcagccacccccggccgcccgggccgctgggggaggggcggcgtctggggtgctccctttcagccccggagcccgtctgctgtgtattcggccggtcacatctctctcccccaacgccctgatccgccctccaccttcctctcctccaggttctgggccggagaaggggcgacgttcgggcaccccccgaatggacaatctttccttctgtcaacggcaggggcaggcctagtttgactctgacagtcctcccactaagcttctgttgtcaggcatttggggcgtgtaagtctctgccgaatatagcagcatacgagaggatccacttgcaagtatttcccagttgtgtgttcttcggcggggggagggccctgggtgccgcctacttctgaaagacacaggtcactgtcagaaagcccaactgtgctgtggccttccctccagccgcccccgtggggcatgtggggtgacagtgtgagccgtcctctgatgtctggctgctagagaggcaaagaacagagacccgaggttccggccacctttctctatgaaagggccttccttgacgcttctccaccttcctgggattgttttcttctccagtccccgaatgggcaggcctgtatataagccttgtttctagaaccagacaaagctggatttgaaacctggcgagccattgaacagctatggccttgcgtaagcggtatagcctccaagcctatttctccatctccgaaaacagggctagatcagtggttcttagtctggaaccggcatcagaatcacaccggaaggggggctcactgaaaatggaccaccgggcctggtgcccaagtgtctgattcagtgggttggtccttaggactggcatttctaacaagttcccaggtgaggtgaggctgatgctgtggtctgggaacacattttgagactccagcccctagcctggtaacacctggggttttgacgcagaagtgccacgttccacgcttggcacatagtaattgatttcattctaacgctagccgacttcatgtattgaatagtttcccatctcagtgtctaagaagctccacagctggagatggcggcccttggtctcggagcccccctccttgtgatttctgctttgtgattgctttgatgaaccatttgggtccaggtgctcctgatcacaccacctcccctatttgggacttgtgccccactcccgctgtgagggctacaccgagctctgggggcctgttcggattaacaaggagatcttgctaaaggtatcttggtgctaagttaagggagatagttcgccatgggctaggatctctcagtgctggtgaccttgggtgagtgtctccctgtaaagtgataaggatgcctgctggaaagggtggtgggaggattaagtgcgttaaagaggccctcctcccaagcttttagttggcctccattgtgatcgtggttattgctgggagtggctgcagggggtgggggctgggctgcctcagagcttccccccgcaccagcccacctgctgaagcacgtgtccctgcctcagggcaaaggggaatctggcgctccctgggaaggcggccaacgcggttctcctctggagtggttgagtccagctgcaggcctttccccatccacaggggctgttccatgatggggtcaagatttgggtcacccacccatggtccggggagaagtgactccccaaggtcacaaggccaccaccaatagagccaggatggggttccaggtggcttgacttggcagccagcgcctgtgcccatggcaccccctcaccccagctgtctgggttattttgggcttcctcccgtgccagctgtctgctggcatccctgcccgggactgtctggttggaagtaactggcgtggtgctgttggctcctcctgtgagggccagggctgggtcttcaatccccgatgagccgtgctgggtccagctcctttgctgggagggaagagtgttcctgcccagactccccgctgcccaagtacagcaagagggcgaaagcacctgataaaaattgaggttcacattgttaatatcccaaaagcctcctccttctatactccctgaaacctgttttaaatttggctctgccattgaaccccgttgctctcacgttaccctctgccgcccgagggtgtggcgcctccctttagagtcttcgttgctctccgggtggggtctttactccccacctgctttggataattaagtaattgatgtacgtctccctcccagctgcaccctggagggctccagccagtttctcccctccctggatccaatcagtgagctgttgggtgctcagctgtggtctggatgtggttctcggcacggtgtcgggacccacctggctggactgtacccctctctctctgctttggtccctcttctttctttgtccccccaccatcacctcttggggcagggagggtgaggcagtttgtcctcctgctgctgttcctgctggtccctcgagggcgccccgcccaccggtcacccagcgaacgcggggcggggccgctgctggcgctgggccccagggcttgcagagagagggccacgccagcggaagggccggccaggaggtggcaggacttgccttactactgagtcgccggcatccccgcctcttccggcctctccgcccggagccctagcgtggaacatgacctttcggaccctctgggtggagacacagcctctgcctgggctgtgcagtgaggtggcaccaccatctcaggtcgtctggcccagtgcatctgtagctggcatgtgacttccagcaagctcctgcccctgagcgctgggaggagcaggtccagcaataatttttttttttttttttttgagacagagtttcgctcttgttgcccaggcaatggtgtgatctgggctcaccgcaacctccgcctccagggttcaagcgattctcctgcctcagcctccgagtagctgggattacaggcatgtgccaccacgcccggataattttgtatttttagtagagacagggtttctccatgttggtcaggctggtctcaaactgacctcaggtgatccgcccacctcggcctcccaaagtgctgggattacaggcatgagccaccgcgcctggccggacaataatgttttgagctgttgctgagtctggcttttgtgacgggaacttttagcactcaaggagtggccttgtctctggcctgtccccgagtgctcatgggcagccaaggcctggggactgctcaggcagggtagatgtatttgccaggccagctcccgtccctgggacctcagggagtagcttcatccctgaaggctgagtgtcttctgcctcatgtgggtggcccctctgcagggttctcaggcatccagggaagtgggtgccacagcgttgcctccagcctcactggggctggctggactttgctctgacaacacagcagtggctgggcccctgcaactctccagggctcagtttccctgttggccgcactatggcataggcccctgtgtggacaccgatgagctgaccccacaaatgccacccggccgctcccccaggcttcagtggcctaacagctgttgtgtcaggaaccagcttaaagaatctttcttgctttctcaaactctccaggaattcctggtgactggaagggggagtgactcaggccctcaacctctagcaggtaagggagctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtcccccactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaat

SEQ ID NO: 5863 - DNA, 10347 bp, Homo sapiens
acaatgagatttcagtgcattctcagcccatgctgctttattgctaaaatatatatatacacaggtgcagagcttccaacttttttaacagttcctttttacatcaaagaattaaatttcttcaaaaaccccaaagatgcatagattaagaagcaagctgccttttgtaatacttaaaataatattcaatgaaactcttaacgttatacaccaatggtgcaatggagaatatggaggacagcaagtaaacacagtgagcaactcttattcttacaaggcagtaggtaaagtataatgtgaaggacagtctaagataatctttctggttataagaaatgggtcggttttgtgataagtgccaagactgttactgtttaaggattgatgataatgtattaccagaatacctttcttatccctgggagaaaatattttttcactgatggaatgacatatcaccaagggagaaaaaaacctgaatactgtcagtaactaagatacctattctgactttaaagaagatttaggacttcatggagaaatctgtgatgtctggtttcccaaaattaagtattttaatgtgccttagtggaataatcggaggaatttagagaaactctgttcttaatctttactggctgacagacatgctatcaagtaattggggaagacaaactatattcaggatatgacatctcacttcatatatttcaatggaaaccaaacatcacagtcacaagaagtctaattcaattctgaaccactggaaagttaccattccactttattcattcccaaagttatttgtagcaaaatcctacaggaaagaatgaaataaaaagttttcaaaaaatttttttcaatcatagaatgtaaaaccttgaatgtgctttgtgaaaatcatttagtctaatcttgaattctatttaggcttgtttcagacatcatgaatgccatttttacgtcatttgtcacaatcacttgtacttatataagggttatttttaaagtcaggaattttctcaaggaaaattttaagctactacaggccaggtgcagtggctcacacctgtaatcccagcactttggaaggctaagggggggcggatcacgtaaggccaggagttaaagaccagcctggccaacatggcgaaaccccgtctctactaaaaatacaaaaattagctgagggtggtggtgcatgtctgtaatcccagctactcgggaggtggaggttgcagtgagctgagatcacattgcttcactccagcctgggcgacagagtgagactgtttaaaaaaaaaatttttttaagctactgcaataaatttgtttattcatcaaataaaataaatagcaaggattttcttctattggaaaaaatagatagcaaggattttcttctagtggaaaaagtttctcctgtttaacctggcattaaaagctttagtcaagaaattgcagtctggccaaacccatcaaggataaaactttggctataaaatttgtttaaactgttttttatgcaataaaataacaaactaaccacagatctgtcagtattttcaggactattctacaaaaaggaagtctcccttattgcaggggtactttatagttggtcattggtagttggtaccagtatcatccacaacatgtgcctagtcatctgaaaatcctgaaatagtggaaatatgtgcatcctgactcttttcaactcaaatcccagttttaaaagacctcaaactttgtctacataaagcatatcataaacaaaccccatatccatatctagttattttacatactccatactggcattccctactttcctactctttctgaaactctgcacctttctgattattacagccatagcagctagttttattcagcatgcttagtttgtgtcttttgttttcaaacatgcttggggactaatggaaccaggcaagtggttagagggtgggcactgctacgccctagtcctgacagtttgaatgtcttgtggttgcccctgtttatcttctacttcccattttcaatggaagtaagaaaaatcctttattaaaacatgaaaataatctgaatatattcaagctattggtcttagtctctattgcttcattattaacaaatgcatatataaaataactagtaaccacaacactggacattttgagtcatgcattagaatgttcgtactctaaaaccagagttaaggtcctgtcactattgcttgcactttcaatcagacccagtttgagtttaataagcatgcaaaataaattccttgattcagaggaattacgggacataacaaggatccatgcaagtttcaactcaaaagttgggttaataattgcttagaaatgcaggtagaagctccacatctatcacaatgctgcttcagaaaagggataggagtcatacacaaaaatgttaaaattaggaccactagtcagttttaaaaggcttatatgcaaatcctggtccatctgagtagagaatgatgtacaaactctgggaaaagaaagagaattgagggatgtagagtcttaaggagctgttaattttcttcgtgatttactgacaactataacaggagagcataggtggtttagggggatggttaagatgctcttaggcagaatggtttcttttctgattcatgctaatgagcattacctgcatagctccctggggaaaaaaatgataacgagcagggctaatacaatgtaaactcaagctatcaataccctgaaatttagcacagccctctgctttttaaaactgttcaccaagggatccttccaaataggatataattaatagccaagcaatgttcattaataaactaaagcaatctgcttgaaccaacagcaccatgagaatgtaaactcctggaggccaagagtcttcatctttttgcatatcacagatacaagaagagtaaacatgagaccacagtaactttgaaaagtaattaactgtatactttcaagactatgaaaaactcgtagtatattttagcatttagatgtattaacatggctgttaagggtaatctttaattgttccaagtaactgaactgctgacatcattgtactatgtagcgctgtccccagatagtgcagatgtctgaatattgcttggttattcccatgtctctaagaccaactgacagcataggacattttaagaggagctataatcaacttaacatagccttttccctgtgtgttagttgtcatgtaagaattaaatattaaagaggcactatttcttagatctacatcacttcgttttttccctgggaaaacaaagacccagtcttttcagggatagtcaaggtgctaaaaggccaagatagacatcaggtgaaagggagtgaagtcaccctagttccactattatattctgatgtgagctgtgtggttcctcagatcaagaaagaaactagtttgctgagttctcattgataaagaataagcagtcacaggccataggacacatctatattagacaaggtttcacacctcacccactgaaacatattcactggctattcctttcagtccttctgctttgcatctttaaatcctaactccctaatcataagcatgagagaaatccggcttatccatgttcttgggagtttttttaaaacattaaactcacaaacttctctccctttaaaaaaaatgtacccaggaaaccagtggagaaagatgaggagacaaagcagaaagtataccattctacaaaataaatgcctgttgctaaaacatcgtaagcaaaaaacccatagagcggcttcagtggggctgtagtacatttgtttccaggttaagcactataaaggtttaatttcaacagctctaaccctctgatttaggaaacaagcagggtctttaacctttaacttacaaaaaagattatttctcacataaagataaattcatatacattcatactgttctaaaagaaagtacctttcatatgctctttatccagaacattttttccttttgtgcattttttgtttgtttgaggtggagtcttactgtcaccaggctggagtacagtggtgtgatctcagctcactgcaacctccgcctctcaggtttaagtgattctactgcctcagcctcctgagtagctgggattacaggcatgtgccaccatgcccagctaagttttgtatttttagtagagatggcatttcaccatgttggccaggatggtcctgatctcttgaccttgtgatccgcccaccttggcctcccaaagtgctgggattataggtgtaagccaccgcacctggcccttgtgcaactcttggttgcagagccccacaaactccagtagtatcacttattctattgtacaaccttgctaatgcaaattactatacatgcacaaacttattgctactaaaattctacctcttgaaaattactattaattttatggctttttttttcaacaggaaatatcctttcctatatattgtgctattctgtattcactaccttttcagtttttttttttttttttttttttttttttaagttaaatgcttttcagtaatggattctcccaggcactaaactacttaagccaggagtataactacttcaaatacactatgagaacctaaacttgggtctctggagatctgctgccagagtctacttgttctaacctgtgtatgcgcaagatacaccacattataatagttttgcatttgctatcatacattagttatgtagaatctgtgtcagcaaatgctggactctccctaatactgaaatttaaaaatcacctcagaaaactgccagttctgagttctcaaggcagcttttagaggtaggaattccttctctacagaaagctatcttattctttcagaacaaaatgactgttttatttccacaagtaaagtagataaaagtgaaagctgtctgaggcttactatacccaagagaaagtctactcactacgtagcaacctaggtaggtgccacccagctacatttccagttctcatgaaaagatctgaaaatcccatcaatagacaattcagcacatttggaaataggaagagccctaacaaataattgaatactccaaattactgagtgtttgcacacagcatgctgcaaacaggaaatgtaaatggtctgcagattagaaaagcactcactgaagcaattaacagcatctccataagacatgcaaaatgtaatttcttgacatacaaggagtaggaaaataatgaaactaaaagacatgccatgttaagacatgaaaagagcaggccaggtggattacttgaggtcaggagtttgagaccagcctggccaacacagcaaaaccccgtctctactaaaaatataaaaattagctgggcgtggtggcacgtgcctgtagtcccagctactcgggaggctggggcacgagaatcacttgaacccaagaggcagaggttacagtgagcaaagattgtgccactgcactccagcctgggtgacagagtgaaactctatctcccccccaccccaaaaaaagagcaaagcagaataattaaatgcggtctcattttgacttgaggtttcataagacacaaagacagctggtttccagataccttatggaaagctgaaatgtcctcaaatatagtatctcagattttgaccccacatttctattcataaatgagtcttttgggccttaatctcttttccccaggaagaatataacagatttagacattatggaaaaagaaaaggtttagattttccactctttttacactatttgttattatcaataattcatcctgaagtttaaaatcactagactcatgcactaacccctaacatggcactacaatatgctaccaagcactaatgcttacaaaactatacacatctcaaaatggaagacattggtgattttgttgttcttaaacaacttgtaacatttgtccacaagtattaaaatatacatatatatatatatatttctattgcacatatcccggttttaacttttcaaaagaaaaactgccagctaacatggatgagcaagggaaaggaaggaagcatggctacaaatcgacgtatagtcctgcctaaaattatagcttttcctatcaaggggaccaaaatagacaagaaaaaaatgtagatgtgttaagtaaacactgggcaactacagctggaatatatccattttgttaaatgcatctggtctgaagcatggaagatacaatttcaagagcattaaacactggttctctcaactgtatataaagcatatagagacgctgagtctgatagctattcaaacaagtgggccagagctggtttcaatggtgccaaaagtacaggtactctaccccctgccaaatgatcctaccaaaaaagatgccagaagtacacagagaagatgggtttaacagacacctggaaggtgtctccattctccatgatatgacattttcaacatactagtggaacaccatatatgtaggctccattctgtcttgaacagttccaaaatattaaagaaaaacatcaggaagttggtagattacttaagagaaaaatttgagttacttttaaccaaagtgatttctactatgcttttatcactcagtagctgccctcaaaaaaagaaatattttatatataatatgtaattattttactgaaagtattttttacccatttcaaatgggctgattgaccaatctcactaataataagagtgctcaccatttcccattttaggccatttttatcactctcaaattttggtgaatcttccctaagttcccagcatcacagcattcatggacctgagtaaacattccggaaaacacagagatgttccaatactctgttcttaatttcatctaattagttttaaaatttattctctactcacaagaagcataaataaaggtttcactcttatataaagacctgacaatacatacaatggtcctctgctgatttggaagcaaagacagttttctacgacagtctgttctttataatgtataactgttgtgggaaaaaagaaaatccatttcttattgtaattatttttcttatttgaggtttcttttccacgatgacccaaccacaagtttgggaacattgcttctgaggcccattctctgatgagaaagttcagtcccaactggggaaagtacctgagtcccagccttttcagcctagaaatcaggctgagcgtggtggtgcgcgcctgtaatcctagctacttgggaggctgaggcaggagaatcgcttgaacccgggtgggagagactgcagtgagcagaaatcacgcatcactccagcctgggcaacagagagagactgcctcaaaaaataaataaataaataaataaaaatcaaacatccaagtatccaccttgggttgcaggaagagttaatcttatgcgtttattaaaaaaagtaactatataatgtgaaacaccataaagtcagatggcactgcatgagggatttttgcttctttttcttaaggaaaaggagttacatggaaaattctctcatcctcccccctctgcccccaactcctctatgtccaaagttgttttttatttttctgagacggagtctcactctgtcgcccaggctggagtgcagtggtgcaatctcagttcactgcaacctccgcctcccggattcaagcaattctcctgcctcagcctcacgagtagctgggattacacgtatctaccaccacacctggctaattttctatttttagtagagatggggtttctccatgttggtcaggctggtctcaaactcccaacctcaggtgatttgcctgccttggcctcccaaagtgttgggattacaggtgtgagccaccacacccggcctaggtttttgtttaaaattgggcctttgttcctattcagtaaatctatgtcacaggatgagccaggatttaaatatacaaatataaatttttagtatctttcacgtcaaattagaaacacatatttggaatttactgctgcagtctcaactgtgcttatcatggtagtggctgaaactggaagacattttttttaaaccctgaagtcattcatacttgctacttctttagtcttcttgcttggaatgaaaagtattcacaaataccaccacctaagcacctgtttcaaatgaaactcagccttctgcttgcaaaatgatgtctttataattaagcaaacagcaaaagacccatgtgagttgcttctttcttcctggagatgttagcaggataactggaatcctaggagctcctctgtgttgaatttgagaggcagaacaaaaagaaaagtggccttttccattccaaatcatggaggtaatgtgtagagaagtgatagccacatttcaaaaacgggaaagtaactgggtaaaagaagcaggactacccactctaggagacaacatagagacacctagaaatacaaaataaaaacagaaagattaggacaggtacttttgcataagctgactcaaaacaatatctaaaatgtaaagaaaagaataggccgggtgcagtggcttacatctgtaaacccagcacttcgggaagccgaagtgggtggatcaccaggtccggagttcaagaccagcctggccaacatggtgaaaccccgtctctactaaagatacaaaaattagctgggcgtggtaacgggtgcctgtagtcccagctactcaggaagccgaggcaggagaatcgcttgaacctgggaggcagagatttcagtgagccaagattgcatcagtgcactccagcccaggcaacagaacgtgactccgtctcaaacaaacaaacaaacaaacaaaaaaaagaatattttggattacatattatctagaagaaaatgaccaaccataacaccaaattcagtactattatcagaaaagcaataacagctagaaaaaaaaaatacaagcatgatacaaaaaaagctggatttatacaagcatgatacaaaaaacttttgcatataaaacatttttttttgtttgtttttgttctttctttgagacaaagtcttactctgctgcccaggctggagtgcagtgctgtgatctcagctcattgcaacctctgccccctgggttcaagtgattctcctgccttagcctcccaagtagctggcattacaggcatgtaccaccacacccggctaatttttgtatttttagtagaaa[450 bp omitted]ctgcatcttcgcttgcacctcctatcaaaagaaaaaagaaacaaaaataaacacaagtagcactgtactccaaatttgatatctaaatatataatactcaaaaccatatatatcttactctgaatcaccttcaactaccagcaataaacggtattttataaaatataactgtaagtaaaatatatactgttccattatcaccaaatgtaaacatgtaaatactaaatcaaggccaggcacagtggctcacgcctattttttaatcatttgatttccttcaatctaattaaatatgtgtctgttttctttagacagtgaaaattattggtagtttgagcaaatgatcaagattactcctttttatttaatacatttcttttgttgaaaaataaaagatttaacttaaatttcaatagcttacagtcatttttcatgttcgtcttctgctgaagctaacggcttattgttccacttctatgtacctgttttcaagctacttaaacagtatttggaacgattagcccacaattacttacttgccaagtcctgagttcagaattttgtttttgagatgaatataaaagcacctaaaggtcaaggaaaattttcttcctgtgataaggaacct

SEQ ID NO: 5864 - DNA, 483 bp, Homo sapiens
ctgctcctctggggcagatctgcagggtacagagcagcaaacaagtccgtgagagcatggcgtctggactgccccttggagtgatggggactggggcccccaggggcacctccctgggcctgttgtatctgttgactcttctgcaaaaagtagacagagaagagagcaggctggcccgctgtgctctactgtgtctgtcccaggactcggaagtattacagttccaaaacgtaacttgaaggtcagcacaggagctgctgtgatataaaaggagagagtcacctggcgccccctgcagtcctccagttgcccagcagcagtgggacgttcagtggcacacagtgggtctctgtatggcctcccacctgcaaggacttccccgggcaggcccagctgcccagaagccccggaacacacaggaagacaacactataggatggcaggtggggatctgtgcaatacaaacatgtagctagaaaaccc

SEQ ID NO: 5865 - DNA, 2474 bp, Homo sapiens
gtcagaactgagttcttgctgaggtttgcattgggccctgtctccgggcagctgcagcataacacggagtcacccttgctgtctaagccttgtggctggaggggaagagtgaggaccaagctgtcaacaatcccagacctgccaagccccatttgtctgtgtgcctgccaggattctaagactgcatttgggaattttgacttttactgaatgtgaaattctgtgtatatatagccttggtgagctgacccagtcagggatgactctgatgtacttttgtcttacaggattcagaatccatggctggaagaggtagtaaggccattgggagggcatgcctctcctcagcccacccccaccctgtgtgggtctccattctgaaatttccattcagatgacccggtcctaggcagggaccaaaattccttgtcagctgaggaagtcctgaagaaacatcctgaagatgatgactgcactgccatcgtgggcagatgcagcttccatctacctgagggctgaaggggaaaacctttcacacacgtgaggaaggcgcagctctgtggaaaggtcactagaatggcagcggcagcaaatagggctccaatgcacgtttgcagttaactgggtccaaggagagcatggccctccacagcaagtttgctctatagaataaagtcctgagcttgtttttatcacagttagacagagaatggtctcttgtttctcagttatccagggaagaacagtgtatattctctgtagatgagtgttgtctaatgtagtgattaatctctgctagtgttaggaaagctccactactgtgtgtgtgtgtgcgtgcatgcgcgtgcgcatgtgcacatactgcagtcttgactttccaattacaaaatgcctaagtcaggtcacattgtcttcttccagccagtttctaaggcaggcaatggaaacaggagccgatgccaaatggtctagaggcagaagggctgcatgctttgcagggccagccccaaggctgccttccagagctgcactttctctggggacagtaaactctcaccgcagctgccagccccctgtgcttggccatgcccctcacatggacttggaatcagtgtctctcttgctgatgagcacctccaggagcctcagtttcgcctttatgtgcttatattcactgtattcttcagccataggagtgcggtcttccttctggacatttctaatgcaaataaaggaaaaaggggtctgaggatcattttctgtctttgctagatactattcatcgggcaaattatcattgtttagaaactttgcagtttatcaacttgtagaatcagtgttgccgagtggcccttggtctcaagactggggctggatttagacaagtaatgaaaatgtttcacccagaaggcaacatgcaactgagtttttatatagttaatctggcatcctgtatgataagaaggctaagaaatgcagaaattctctctgctaagtatgaattcacattgagctctcatacaccaaaatcttttattcatacttaatgttttctcattcttatatatttcatctcgtgaaattttaaatttttaattagcaactggtccacaacttagtttttttttttttttttttttccaaaaacagatagttaatactcctacttatcataaaactgtgttagaattcagcagctggattacataatactattataataagcctttattattgagtaactttacatacataatatttatatgcacaagtatttgagagcttataggtcaagccctgtgctaagtactttgtacccatgatctgatagaacccttataacaccttgatgagatgcagccattttctacacactacacatgatgaaaccagcacaggaaatcagataacttgcctgctcttggccaccacgcggtgcgctgctgctttgtgttttatgggaaattgcacatggcaaacattcaaccataggcttcctgcctttattattaaagggcaaatatgggtaaggaggatagcatggggcttgatttgttcaatgacctaaaaataaactgatcttattcataccctgccttgttctaggaaaggattctagtggcttctcagcagagggcagggcaaggaacaggtgctcaggaattggagcatctggcacgcaggcccccactgcactctgaggggcttcactctcctcagacacgaagtcatggaaccagagcttatctcctaagtccctcatagttctaaacttttttgacaattaagttaacgtcctccattgacattttcttaaaacctgggtggtttgcgtaattctacatgtataagatatctgtgcataatgtgacttagaataatataaaaaaggataagccaaaaaataggcttagatgaaagactggaaagatacacgtcaaaacattaattctgacttgtctttggttattatt

SEQ ID NO: 5866 - DNA, 2168 bp, Homo sapiens
attttgatttaaggtctattttgtttgataccagtatgtccatccctgctttcttttggttactatttgcatggaatatctttttccattcttttactttcaatctatttctgtctttggatctaaagtgaaactttgtagacagcatatagttggattatcggtgttttttttgttgttgttgtttgttttttaactcattttgccagtttctgtgttttgctctgaggatttaatccagttatatttaaagtaattactgataaggagggacttacttctgtcattctgctatttattttctatgtgattttagcttttttgtcccttatttcctatattactctctttttgtgtgtttgatttttcaaatgtgaaacattttaatttcattcttgtttcattttgtgtatattccataactattttctttgtggttaccatggagattacatttcacatcctagatttgtaatactctgatttgaacttttaccagcttaccgttaataacacagaaaaactctgatcttatacaactccatccccaacacttgtagatagtaatgtcacaaaattacctctttatacattgtgtgtccaaaaacatagattaataattttttaacacattcgtctcttaaatcacataaaaaacaaaaagtggagtacaaaccaaagttacaataatatgaactttaaaattttcccaggtatttgcctttactagagatccttatttcttctcatggcactgagttactgtccagtgtcctttcatttcaactggaaggactccctttagcatttcttgcacagcagttctcttggtaacgcattccctcaattgggaatgtcttcatttctccctcagttttggtggatagttttgccagatttaggagtcttggttgtccgttcttttcttttagcactttgaacatgtcagcccactgccttctgccttctgtcttctgccctctaaggtttctgatgagaaatctgataatcttagtgagtatcccttgaatgtaatgagtcacttcttttttgctgctttcagtattctctttatgtctctgtcttttgacagtttgattataatgtgcctcagcgtgagtctctttgaattcatccttcttggagctcattgagcttcttgggtgtttatatttatgtctttttacatctgtatagtgtgttaaaataaaaaaaaagtctttcatcaaatttgggtagttttggccatttcttaaaaatagtccctcttcctccttgtttctctctttcctctggaactcccaccttttcttctattagctgcatgttggtttttgtctgttacaaattgagctactgtaatcattagtgtgtaggtctttgtgtgggaatattctttctcttctcttgtgttattatctaaaagtgcaatgcctttgttgcagggtaggtgaatattttacattttaagaaactgccaaattgtgttctaaagttattataccattttacatcccctgcctccctgattgtgagcaagagttccagtttcgtcacataatcaccaacaattgctatgatctgtgtttttaatgtttataatgctactagggatggagtaatagtatcttattgtagttttaacttgcatttctctaaggcttcatgattttgagcatattttaaatcatgtttttatttgccacccatataacttctatggtaaaatgtctactgatatctcttgcctattttaaaagtaaatattagttgatattgaaatagtaaagaaattttttggaactgcagtcatttattaataatgccagtgacttatttgttttgtagggtaattttgaatattggaagaatatttcctcaaaattttgtgctgttcacaatgggaaactagagacatgaaacacttttaagtttaatctgaattattaacatattctctgctttcttaagtctacctggtcaataaaacaacagatcaagttctggtttgtagtgtttaccaataccctaggtgtaaatacttctgtcttggccaatttcaagctacaacatgatgtctctgaatatggagttgggaagatatgtgcaatagcacgccattgtattctgtttccactgaatagatgcaataaacgtaaataacctct

SEQ ID NO: 5867 - DNA, 804 bp, Homo sapiens
gtgggagctgacctgtgcattacagaatgtttaagagcatccctgaccattatacactagatgcagtagcaccctatcagttatggcaatcaaaaatgtctccacatcttgtcaaatgtccccgggtgaataaatccacccctagttgagaaccactgctctagttctaaaatatttcttcctaaaacataattaaagtaacttattctatattttaattctaagatactctttttttgtagaattctagccttaaattccacttcatctctttaataagaaaatacatggaacacatatttgctaaagattcttaacagtcactgattggcacttgaaatactttcatatttttatttactttacctccagtatggcactttgggttcaattcagtagttgccttaagtttaaaaatactgaatattatagtttacctcttctcttcttttaagagcttacgcaacttttctgcacttgtttctattttctttgttttctgcttttcttccttttcagcttgtttttctcttaattccaaagatttcttttagaacccagatatcgaaaaaaaccacacgttaaaaatagcagaatatataaaacccagtattcaaaagaccacccccaacgagaaacccaatttagtaaaaccaaatcaccatagagccagcattaaacagtatttttttaacataaaaaaattagtcatacagatgtttggcattagtcattgaaatggccagaacagcattgaggaccatattgcagttggtatcccataaaaaaaggggaagccattgc

SEQ ID NO: 5868 - DNA, 7768 bp, Homo sapiens
gctgaatagctgagaggcgcacccgggcggccagctgggctcggagtgcagcggggttaggatggacgaggacgtgttgcaccctgaagagcctcatcatcgcctgctcttgaggttcacagatgatacctttgatccagaacttgcagcaacaataggtgagcctgtgtttaaaaattcaatagaaatgtctaatattttcttgcctttgggcttttttatctaaatccttctaccttcctcttaccacgccaccacctccatgtctgttgacattttatttgtccttcaagatttaactttggtatcgttaaatctcttgaagcctttctagatcttaccaagagaaaataatttccttatctgttgtatcatgggactttattaaaactactgatattatggttatctatacacacatttctttcctctattatggattgtcttttattttgcaatatacaacagttatttgagtacttactgtataccaggcactgttactaagaggtgggggtataatagtgaataacataaacttggtctctgtcatcatggacctaacagtaaagtacattaattgtgtatgttcagcatttgctacagtgtttgacatgtattctgatctttacatatgtattcatattagttattaaggactgttaggagcaatgatacttaaatgccttttaaagataaaatttagatggcctgaaagtggttagtcacactaacttatgaaaatatatgagaagatagagataagtattttggtgtcatgtgtttagaccatagacaacaacgtaaaggaatgaaaagaccgcttggaatagttgaaaggtagctgagctgagtcagagctagataatagtcttggctttgccttgaattaggtgtaatcttgacttactaacttcatctgtaaattgggaggttttggggagagagaatacttttttttccctgagctttaaaatttaaatcataaaattttaaatttgatgatctgatgagagtatagtaaagatgatcctagcagtattattagggaaagcaaatagtttatcttaactgcctttatttgtttacatttattgtatgtctattttttcagactcatatatctgtaaaaatagcaaaaataattcttgtatatcctactaaattactccatccaaatgttaatatttgtcacatttgctttatcattctctctatgtatacacacacagtattcttttaaaaaaatgcatttttttctggttttttaaaatgaattatttgagagtggattgcagacatgatgtctttaaaatgtctacatactttgtatatttcttaaatcaacatagatacaactctattgtctatacacagattttatcagttatcccattaatgtcctacatagcaaaagacaaataatcgttttgggttcaggatcatacattgaatttggttatttctcttcagtctctctttttttttttttttgagatggagtctcgccctgtcacccaagctggagtgcaatggtgcaatctcagctcactgcaacctccgcctcctgggttcaaacgattctcctgcctcagcctccgaagtagctgagattacaggcacatgccactgcgcccagctaatttttgtatttttttttttttaatttttgtatttttagtagagatgggatatcaccatgttggccaggctggtcttgaactcctgaccgcagatgattcacccacctcggcctcccaaagtgctgggattacaggcatgagccactgcgcctggccactcttcagtctcttttaatctgaacagttcttcagtctttgtgtttccagggccttgacatttttgaagagtaaataattattttgtagaatgctgcttaatttacatatattcggtgtccttatggttggattcaggttatgcacttttggcaggaattccacagaagtgtttctcagagcacagtgtcaggaggcacatgatgtctgtttgtcccatttactggtgttgggactttggttactattgggtgatacatgccaactttttcctctgtgaagttattatttttcctcttgtaatgaatatatttcttttggagagatacatcgaaactttattagatatcctccttttcatcgtattctttgccctcttattttagcatccattgatattttttgcctgtgacaagcgagaaggacagtatatgatcctgctgttctaactgtggtggctatcaaatgacaatttttttcaaatgccatcactctgtctacatatcttatttggaattctgtaaggaagggctctttgttttatttttaaatttgagacagagtctcaccctgtcactcagcctccagagcagctgggactacaaacgtgtgccaccatgccgggctaatttttgtattttcagcagaggtggggtttcaccatgctgctggccaggctggtctcgaactcctggcttcaagtaatctgcccaccacaacctcccaaagtgctgggattacaggtgtgagccactgcgcccaaccaagagctcctttttgtttttctttttttgtgaattcggattctttatattcaggagttttacttaaactttgaatctgaaagaaactttaggaggagctcatagatttgtgggaagaagcaaatctacattattttctctcttctaaaatcatattccatgtattttgatcttttactgaattttaacacattgtttcatcactaacataaagtgtttcaatagtttttgtaactcacacacaaatactggatttaaaagttatatacctgagtatatttttgtggcaggtggtccactttacatcactttccagacaactggaatttgagacaatgtctgtgacagcagtccctttgttttcacctggcatatgttctcatcatactgcttgcagtcatatcatgctgcaggtaaaaagctttgattggtttttaaatctcttactttgtgaaaaatattttattgtggtaaaatatatatgacataaaatatgctattataacaactcttacatgtataatttggtggcattaattacatccacactgtcatgcagccatcacaactatctgttcccaaatatttttcatcaccccaaacaggaactctgttatcattctgcagtaactccccatcaccaccagccccccattgccagttaacctttaatctgctttgtctctgtgaactttcctattctaaagatttcatataagtggaaccgtatatttgtctttttgtgactggctcatttcactaggcataatgttttcaaggttcatccttgtagcatgtatcagacttcattcctttttatggctgaataatactgagtcctccaactctgttcgtctttttcaagattattttggtcatctgagactccttgcaattccatttgaatttaaggattggcttctctatttctggggggaaaaatggttgtcagaattttgatggggattgtgttgaatctgtagattgttttgaataggactggcattttagcaatattgagtctgccgacccaggaactaaggatctttccatttacctaggtctttttaagtttcttttaccaatgtttggtagtattcagcatgcaggtctttcacttccttggttaaatttattcctaagcattttatttgtttagcgctatttaaatggaatagccttcttaatttcctttttagattgttcattgtacatgtacagaaaaacaactaatttttgtgtgttggtcttgtatcctgaagctgtgctgaatttattaactctagtagtttccttctggattcacatgtatgtacttctagctactcgggaagctggggcagaaggatcagttgatccaaggagtttgaggccagcctggaaaacacagcaagacacctacaggtgtgtgcccccacatctggctaatttttgtatttttagtagagatggggtttcaccagtttgcccaagctggtctcgaactcctaggctcaagcactctacctgcctcagcctgccaaaatgctggaattacaggcatgaaccaccgtgcccagtctaaaactgtgatatcttgttctcattaatagctgtagaaattataacttttggctgggtgcggtggctcactcctataatcccagcacttagggaggtcgaggtgggcagatcacctgaggtcaggagttcgaaaccagcctggccaacatggtgaaaccctgtctctgctaaaaatacaaaaaaccaggtgtggtggtacacacctgtaatcccagctactcaggaggctgaggtgcgagaatcacttgaacctggcaggtggaggttgcagtgagttgagatcgcaccactgcactccagcctgagcgacagagcaagactgtctcaaaaaaaaaaaaaaaagaaaaaagaaaagaaaaaaaaattataactttttgtaaatttttattaggttggtgtcttctactatttcagttgcataaatatcatttgaggtgggcttagtctttgaaggctctttccagcaggtgtctctttcaccaggcttatttataagcctttattttttttttttttacagtaaaagaaagtctataatatatcaactgtgccaagggaagacaacagtaaacttacaagtctctttccagcaatctaaattagtaattcaacaggacaaaataaagacatttttagacaagagctttatctctctgtgctgcctcctggttaatttccttggttttatctttcagtgtattaattctttccagccgtattcagtctgctgctcagtatgaccaacgggccttagattctctgtgtgtgtaatttttacttctagaagttctatttggttctattgcaaatcgacttcttgatttctactttatacttttatgtccttaatttgtttaattacacttatttatagtcttgttcagattgatcaaatctggttgctcacattttctgttctctctcattgatcatgtgttttattatttggaattatgagctcatctttagtgagaatctgcaatgatttgatttaggcatttatcttccagctctgttctgtatttgcttcttccagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctggcctccttgtaaacccaaaccgccaggtacctcaattttcttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggagggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcatagtcttgcttttgtttcaaaagcttttatgagatttgtttactgtctgtggctatatggcagacaatttgttcaagtggcatgcctcctctttctcacattgacctcctcaggaggagtttttcaagggcaatgagtcttctctctgagataagaatagtagccagaattaagagggtaaagtgcattgtggaattaagtactgattccagtggaaactcactttatggccttagacaaatatttacccttctgatcctcagttttctgtcaaagaacttctgctcatatccaattcctataaagtgggagtactctaacctgatattaccaacattaggttagattttatcctaatgttaggtattagaatatatcctaacattactagttcttcactcttactaaagtgcatgttagatttcttcaatgatttttttaaattggcatggttgatacaaagcatccttctatccaaatactgtgctcagtcgcctaagtgatagtttagaaccatactatctctctgtggaaagaatgctggggctcctggctacacactttgagtagaagggaaaatacccctcttgtatttatgatgttttttctttctacttgattaagaagaaagtacaaaaaggtgcttattgaagcattgtcaatttgggaacaagattctcaggaatgaaatatttgtgactgttctcagcatgaaaggtagagagaagattacttgatcattatgtgcttatttgaaagtcactttcctcccatgcctcaacatctcactttttagaatgcacactgaatgcctggaatctctttgttttagaaaagacaaagttgcattgtt

SEQ ID NO: 5869 - DNA, 3946 bp, Homo sapiens
atctgtttcccaaatcagagttggtggacagagcaacgacaatccagctggagcgatggttcagggtatgtgttcacccagccctttcgggacgtcgcgtgcctgcactgtgggaacgcaagtggacagccggtccctgccgtgggcgctaggggccagtgctcagcgcgggaatattcccaccgccacgtgcgcgcggacagcgggtactctgaggaggggcctgcagcccggctggggctgggaagacttcctggacgaggggcagcccgggttttcctcaaggatgagctggagtcggcccccggcgcaggagcaaggtgccgggagagggccgagctgggtgagaggcctgggccagccaacagcggccttcgagcagggaccgcgcagctccgtgtccccgcagtgggagggcggcgggcaggggccgggcgagttaggccgcaagcatctgctggggccgtcgcagcaccatcccacagaccgccactgaatcaacagcagccagttctccctgggctctggaggccggaagtccaagagcaggcatcaggatgggtccctccttggcctgcaggtggcggccttctggctgcgtcctcccagggccttccttctgggcagcacacctggctgctctgtgtcctgatcccctcttctgaggacaccaggcagattggattggggccagataccttccaagaggcagtcctggacaaaggcagcaggatatgccgggctggcagaggcaagggatcagtggacaaccaaatggccttcaaaccaacagaggatgggtaaatttggatgcatggatttgggggctttatgaatttagacattttaaaatatgtattaataagtaacagaaacttacttctttaggcacaatattagaaatattggaagtatattagaagttattaaaccaactggagatctttttagccaatgttttaaacacatttatgactagagcaaaaacttactttcaaaatattgtgatagttgtatgtcgacataacttaggaaaattgcacacatttttatcttatgtagtttaaaactattcttctgtgaagaggtgcataagtttcacccgattgccaaagagtccatggctcaaaaaaggttaagaatccctgtttaaccaaagccacggatgagatgaggtggagtccaaggagaggaaactaaagactcattttaccctctagtaataagacgtttgggggctaggacttcagaaaagttcaactgctctggagcaactggaaagttcagggcttcaaaatataatacaggtaaagaaaagcaaagtattggtattcttctgatgacaaatgttctttgattttcatcatccttctgaacacaagtcacaagtttgaaaacctgtataatgctgatcatctcaagtaccctctgccttcaatcttgggtgtgtttatttgaaacctaacaatgtgtgcaaaaccaggagaaggctggggagtgagggattttgccaaagtcacacaagtgtgtgtgctgtttttgctccaagctgattagatgcttctattgttatgtatcaagacatctcagggtgtggttgccctaaaggagacagtgaggcaagaaggtgacggcatttgtagttaccagccaccctcctgctcttttaggatgtttgtgtatacacaccctaatgccagcacatgaggatgtggagaccaggcccaggaggaatccatcctcacaaacactgaagaacccagttatccgtgtgctgatccacacgctgccggcaaagcctgtagctggcaggcatcatgccacatttctctcccaaagcaaccctataaacgtaatccttgaacagggccttctcatttccagcagctctttcataattttgtgctttctactttttgaaatgttgtcttggctcatcccacttgaacctacagccgtcagcttctttaataggggtgtctataaagaactgccctaaaatatgcttttccagtgcacttaatgtctttccaattacatccagatgtgaaaagctgaaggaacagttctcaggactggacaagatgacataaatcttgcagctgacagagatcccactgagctcagttggggaaactcacagagaacttgtttggggccagaaaagcggctgggtataaagacagatgtgtacactcggattcaaaaaaatatgttaagagagagaaagcgttcctctaacacagtgcctacaaatacggctgaggcatgaagcaggctgggctacccaccccccgcaactagatcaaaggaggtgattgaaaaggctttggagagagcagaccaactcagcgatgcttcctggtctccttaattgctcttctcagggtgaggaaggtgggcactcctgacagaccttgctggaggagaacaagggctgtttgtgcagctgaggacttggcttttatttttttaatgattaggttttgtacactttccagaatgttccttttaaaaatagtatattcttccttctcttctccagatgctaggaagtgcaggttcaacccaaaccgtgtctatttcaaagggacacaaaaacccagagctggagttaaaggagcttggcggcatgctgcccaaggactgaaggctttggttttcttttaccttcccaagtaattttgtttttgaaggttggaaaacaaattccacagaaggatcagcttctgcaggatacagcctggagcaaggcagagcaaggagctgggtgcagggctgagccaggaccagggcagacacggtctctcagacaggtgccgccctagacagacagctcctgatgcatccaggggctcgctttctagtatttcaggttcccaggggaggaactgagggttttcttttttctctcaagaggctccctccaattatccactgcctcttctctaactcttctctctctctctccctatcatgacacccggctctgtgacagaggacagaggggcttcgctgcacacttgctctgaggaggctcaaagggcccatttgcagcacctggtcagggccactcttgcaaacctcgcctgggcccagcccacccagtgctggagaagccctgtcctccttggctgagaccttttgcttttcctgccatgcatcccacggaaggcctgatgatggtgcatttcattgacaattttatgaccctggccatttccccctgtaacaatatctttaaaatggctccttgtcttcaggtgggtgagagcagggctgtgctcttccctctccttcctgtcactaaacgtctgtgccttaagcaataacactgaagtagtagaatgtgagttctggatcacagaactgcacacataactttgaccacttttgtttccatcctgagataaaagccaaaacgtattttttaaatttatgttttacatcttttagttgggcattgcttttctgagtgaattctaagtattgtaaagatgtcttcaaagacagacaacctcgactctaaagaaattaatgcaaattacagtgtatctcagtgacatgctaatttatagcaccgtaaaggtacagttcaaagctccaacgagccagaagaaagtcggtggattgatggtttgcagtaagaaaggtttagaaacaataaaatgtaactaggattttagtttggaaatgaactaggggtccatttgttccacgttactgagtttttaatttagatctgctgttaaaacctaatgcattttgtatttgtggctagtaaatgactctgactcggtgtcttcaaggagacattgaaaaagaacaggaacaattctcaaagataagacttgcagctgcaggtttcttaacaaaaaatataatctctagatctcacctctaaaatgtgattacaaagcagaaaagtaaaatgaaacaaagaaac

SEQ ID NO: 5870 - DNA, 216 bp, Homo sapiens
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtgg

SEQ ID NO: 5871 - DNA, 581 bp, Homo sapiens
gcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataatta

SEQ ID NO: 5872 - DNA, 3409 bp, Homo sapiens
agactggtgctagcaacacgggattggctaacgcatcctcttgctgttcccggtgtttgggccttgcctgtgacagtgggaaaaaaaatggccttgctgtgctacaaccggagctgcggtcagcgcttcgatcctgagaccaattccgacgatgcttgcacatatcacccaggcgttccagtctttcacgatgcattaaagggttggtcttgctgtaagagaagaacaactgatttttctgatttcttaagcattgtaggctgtacaaaaggtagacataatagtgagaagccacctgagccagtcaaacctgaggtcaagactactgaggagaaggaactatctgaattaaaaccaaaatttcaggaacacattcaagcccctaagacagtagacgcgataaaaagaccaagcccagatgaaccaatgacaaatttggaattaaaaatatctgcctccctaaaacaagcacttgataaacttaaactgtcatcagggaatgaagaaaataagaaaagaagacaatgatgaaattaagattgggacctcatgtaagaatggagggtgttcaaagacatatcggggtctagagagtctagaagaagtctgtgtatatcattctggagtacctattttccatgaggggacgaaatactggagctgttgtagaagaaaaacttctgattttaatacattcttagaccaagagggctgtacaaaagagaaacatgtggactaaaaaagatgctgggaaaaaagttgttccatgtagacatgactggcatcagactggaggtgaagttaccatttcagtataggctaaaaattcacttccagaacttagtcgagtagaagcaaatagcacattgttagatgcgcatattgtatttgaaggagagaaggaatttgatcaaaatgtgaaattatggggtgtgattgatgtaaagcgaagttattaactatgactgcaacaaagattgaaatcactatgagaaaagctgaaccgatgcagtgggcaagccttgaactgcctgcagctaaaaagcaggaaaaacaaaaagacgacacagcagattgagtgggagatgggaggaaggctattacgtatttcagaatttttaatactgtgtgaagtggtggcttgctgctgtcatcttttgttttgttgttgtgttactgaatgtggcatttcagggttaacattaggttcttaaaagccaaagtcagtttatctttttgtgcctctcatctttctttcgtgttatgtaagattgattattcgtttctccctactggtaggaaccatagttgtgtcctgtacttgaagaggctgaaaaatagcccataaccataattgcagtatttctttgtatttctctgttaagcaaagaaatattaaggaactttttttatgtctttgtattattccataattagtaaagctaattgtgaatgtccaattttaatgaaatgtccaattttaatcagtttttttcatggatttgtgttcttacggtacttgaaaatatttaaggaagagatgaagctctgcagttttttctatgtgggatgattgcttttttaaggaggattaattctgaggtagtatagtaagtaaaggggaatatatgaattgttaacaaattaggatttgtttacaactacttgaatttttaaattatgtcaaaacttacattacttgccaagcagtatgatgtaagagtataggaaacataaataagaatacagaggtatcaatttgattaaaattcaccattttataagactaagcaataatcttaaaaacctctttcctgaatatttaaatgtgtttgtatggtgttatgactaattgttactgatttacagactaagccctcttaaaacctttagttaaatataaaaagaaattatatatatcttgcctccctgatggaaaactatgtaaaattgtagacttaaaaggtttgtggaggccgggcgcggtggctcatgcctgtaatcccagcactttgggaggccgaggcgggcagatcacgaggtcaggagatcgagaccatcctggctaacacggtgaaaccccgtctctactagaaatacaaaaattagctgggcgtagtggtgggtgcctgtagtcccagctactcaggaggctgaggcaggagaatggcgtgaacctaagaggcggagctggcagtgagctgagattgcgccactgcactccagcctgggcgacagagccagactccgactcaaaaaaaaaaaaaaaaaaaaaaaaaaaaaaaaaaaagtttgtggaaatacattaggatatcagaaaactaaatatatggagttgctttatgactattacatgttaaataaaatagcttgttttggagtttttttttttaaagtcatgaagagcttcacaattctagtgatacagtgttgattatatattgtgctttatttattttaaatataggtaacacagaattagatcgtttggataggttttgatgcagtgcagagcttaagaagaaaaattaggaaatattctgaaggccagaactctggaagaacttagaaagtttgggaataaattaaacttacatagatttaaaattaaaaggggtttatttcccaaaccccttgagtcttttcttttccttggcatttgcggaattcttacaaagaaaaatttacagaagtactattttcgttaataaagcatatatatcattctactaccattagcaaataacttagttgtagttaatataattgttaaaaggtttagctctgttacaaataaaaacaaaaagatctggcaaccagactcatgatgttacactaccatgacaagaaactctgggcagtgaaagttggacccacatggagtacataaacatctgatactgggagatgtatttaaaatttttcaagttatattccatgatttaggaaccatttagagacatgaagtctttatgggttgggggaaaggttgatacttagtttgattaaaggtaatgattaatatgcctttttgttaatacttctttctgaggctgtcttcccctaaacagtatcttaatctgttaaatgtaattgaaatattatttgaagcagtgagttattgtaacctcagattagttacattgatcaaaacattgatttatacacacacacacacacacacacacacacacgcagcttttatatttagtctggttacattagtgaccatggtatttcctttcttacttcttaaggagcctttgaatttcttgtccagataaaaatctgaataatatttatcttagactcatacataaagggacacagttaccgttaggtagcatatgttttactatcggtttgtcaaaaaagttaataaaaaatgcttattgatttgtttctctaa

SEQ ID NO: 5873 - DNA, 2740 bp, Homo sapiens
agttgctcggcgggcgccatctttctcgcggcgcgggcggcgccctccgaggacatctcgatgaccagggcgccgcgaggcccggggctagcgggagccgagagcagggtgctgaattctggagatgggactggggtcgcgcggccttctccttccccacgcccccagacccaaaagacgaggccgccggctcggagcgggaagggctggggccagcttcttcctcctaaccacttgtttgtgatggaagaagggggctgggggtcgagcctcgcggctgatgggttccctccctgaccccgcacccccactcctcccagtcgaaattggaggtgaggcgctcctgccattttctctcctgcggtctgagagtggacgtctttgtcttctctggcccggcgtgggggcagggcattgagccttttccttaattcttcagttattgaaagtagagtccaaccaggttacaaaactaaaaaaaagagtccaggacattgtctgtctgccttccggtagcatggttctctgtgggtaccctacgcttcgtttcttagttttactctaaaacaaccctgaggagacatttactagttgtcagattacgggaaggtgatgggttccagttttttgaaactttttttgttggctttcatattacttcaaatggcagtgaattaaaacagtttcttagaactctaatctgaaaagttaaatacgctttaaaacagtctgaaactcttctaaaaagcaaaactgcattattaaaagcatccatgtaagtatctgttggtagtatctattagagatgggggaggggtttaacttttacattattattgaaaagaggaggggaaaggtctataaagctctgatctctctagaagtccacatacatggaaagtaaatagttaatttctagtgtagaaaaataacaccgtggtgccagtaggtgtgtccttgtgtttataaatatacatagtggatgttttagaccatttaatgagacctattatatattgaatacctgctgtatgccaggaactgtgcctgatgctttgtataatttctattatatcagcccagaaatagtgattttatgatctgtctaccggggaatgaactaacgttcatagaagtatagtaattgttcgaggtcttgcagttttaagtagtaaagttgccattggatcacaaaagctgtattcttccccctacacctatggtttccaaatgtgagcatcagaattaatttgggagatgtttttaaatagagatttgtaacatcacctcttccaccatcatttgctagggccaactgggtcttttaataatgtgtcaggcactccaacttcttgatgttcaatattgacattctggcccaccctgcacccgctatatccaaagatctagtattccaaagctctccaggtgattccagtgacacagacacacgtttggactgtcttgtactatgctatgcactgttctgctcttttttgaattggaacatgagaattgaggtccatgtaattttgagtttcagtagttttttgctcacattagtctcatttttgtttttcctcttgtagctgccatttatcaaatcgaaattatttcctcagagaaaaaggtttaggtatcctaagactttaaaatctcagtacgtttttttttaaagtatgttgtctcattctattgagaagttatacaacatacaggcttctaggtctagccaggccatctagtttagtcaagacagctgtgtaacaaacgtagccttgaggcctggcacggtggctcatgcctgtaatcccagcacttttggggctcaagcagtcttcccacctttccctcccaaagtgctgggattacaggcgtgagccactgcatcctgccgagaaaatcattttttatttaaataatgtcaaatggaagtatgtagcaccccccccccaccttcttttcccctttctttcctctttgagtctgctgtcattccctttttcatgagttttctctgctccccaaataggctaaacaataaccgtaaagtgagattagagaaaataagaatggagtagatgatggaattcaaaatagctgtctacattcttcactgagaaagatagctttgagttaaaggtgagaggagcaaatctggggaaaaacgggtgaaacggcatgatttaagtagcataccagatgcgtttctgcatggcatggctcttgcttgatgaataatgttctgtatagtagaagaggaaaatacagtgagtgaaggagctggcagaaggtgggctgggggagttggggaagagtgaaatgagtatggagaggtgagagagctgactgcaaaggcatgtggggtgtggattttaaaaggaaagccctgaggtggaaatcactaacatggtgcctggctacaagcagagggagctcaggacttgactgtgctgggggtggcctgcccttttgtagtgcagttgaggagagctcaggggctgtcagaatgctgtgtgggaaggtggaggatgaaagaggacctgggagcagcaactttgttctggtttgttgttttctcttccctacctcgtatgtactcccactcaggaaaagatcctgagacctctctgtaccagatcctcttatacccaggttctccttaatcccaatcaactttaatctataaagttacgatttgtttacttataaatttatttttaataaagttgtgaaaccg

SEQ ID NO: 5874 - DNA, 1078 bp, Homo sapiens
tgggcaacaagagcaaagtctcaaaaaaaaaaaaaaaaaaaaaaaattaagtcagctgcaatcctaattatatccctcaatcaactaataagcagaaactactatgtatatgacgttccatttgtgtggtgtgactaaaggaggaagattttctgaaaatgccaagaacaatactaaaattatatgcaaagaaattaccagcattaagtgcaaaaagtcccagagaaaaacattatttataatgtacaattaatggtcaacattggtcactaggataaaacacaaaaatcacccctaccatttttatgctttagcagctcctcctctcattctaatttagaatcccaatttcaaaagactgatccagacaagattaaagaagcttataacttccctagttgcaaaagttccaaaagcaagctgaggagaaaggaagattctttaaaacttccccaatcttttaacagctcttctccctcttattatccggattcatctgtaaggttttaattccaacaaactcttgacagcaagccgctcctctctctaccccaccccttgtctgtgacgtgtagcattctgtaattttactcaggctgtgggtaagtctcgactaagtatgcagtgagtttcataggaggtgacaaagaggtgctgcctttttttttctccaagcccttcttactgactgtgatgtctcttgtgctgtgatggaaataagacatctaaaaaaagtagggtttttgttgttgttgttgttgttcccctccattcatcctctttgtattattaattggtgcactctatcttgaggcatcaaatactaaaacaattataagtattcagactatgtctgaagaatggctcaatctaaaaacttaaaagtatagggctatttccatcacctgctagccattcaattattttttgtgcccttaaaacttcttataaacatattcaactataattcaaatggtttaaaaagctactctggtggtccacagaagtaatggctgctctgtagattcaagctaataataaatgactagcttggtgttaccttaaatgggttctggca

SEQ ID NO: 5875 - DNA, 2686 bp, Homo sapiens
cgcttcctgcgcctgttcaggtcatcgcttgctctggttcccaggctttggcctctagtggacgagaatcaccgagtctgcggggctagacgctgaccgcccgggccagcacctaggcgggcgggagctgtgcggcccagggttcgcgcgggccgggtagaggctcgagccaggacccccgagcgtgaaccccggagccggcggcgctggggccagaggggccgggcgggaggtgatggcggaggcgaaggggcgacgggacctgggcctggcccgtgtgtgtcctcagaggcctggcgccggccgtcgctgtacggtgagccccagggaggcggatctgggccccgagaaggacacccacctggatttgccccataggcccggcccgggcccctcgggagcagaacagccttggtgaggtggacaggaggggacctcgtgagcagacgcgtgcgccagcgacagcagcccgccccggcctctcaggagccgtggggcagaggctgcggagccccaggagggccggagccctcatgacttcagtgacctgcttctgcccctctaggtctatcagccacagtctctgcaagtttccaagagcagcagaaaatgaacacattgcagtcatgttgtcataggaacaactggagaagaataaagtggacacgaaaagggagagtattcttccaacgataatactcacatcgcagaacgcgaaaatcttctgtcaggaggggcgatcctcagagtcactgggctacacaccatcctggagttgcgaggggacagcacagccttcttgtgataaccattccagcacactgtgggaagtacccccggacaggaatactgggcctgatggatcggatagcgtcttcgaggtgttattacaaaccgatctggtaaagtcccacgatccctgcagagaatgcgagacaaatcatggaaacaaagtataaaagaatgtcaaaattttagacggttaaaaacccaccagttaagacattttccaaagaacttaagtctctttctacgcaacacagaacacgttgtttttatggcaactttcccctattccatctaagagcagagagtgacagctgcttaacagctgtctcaacaatggattgcaacaatttgagagggaaaatctaaatctagactaaatctagactgcactaaaattcggggagtttttagaactggaaagaagggaatcgttttggcaacacatctcacaccaagcaagagtcagaggccaggagacggctggcacacaccaaggtgttaaggagggcaaaaccacacacaattcccttcggatttgatgaaaaagcaaatcggatttaaaagtcctcgatttcaagccagccgagccaaaggatgatctgggaaaatcagcgcatctcaccgtggggaaggcctcccggagggtcggagaagaggagtggggagagaggggtaaaagtggtgaacgcgatgggtcggcggggagggcggtgtggagcgcggcgccgggcgggcgggcggcggccaggcctattccgcaggtcctggccctccggagcgggggcgggctgcggcggcccgggcttgcccaggtaactgcccatgaggagcagttcggcagggtcaggtccttcgagcagggtccgcggctctaggaggtttccgttggctgtcgacttggccggaggcgaagcgaacagtgttcgccgatgtcgcgccttctgaacgaaggaggacaaggggcgcgaacctcggggctcgcggctcagtccccaccaggccgcggtagtccccacggccagccaggccagcgcagccgcagcaggcacgaggtacagtaggaggccgaccagcgacaggccgagaagcgccgccccggccggccctgacactcgctatcggccgccgccgctcgcctgctccagccgccgcagccgccggagacatcgcggctccgcgccgcggaggagacttaaatatcccagcgtgcaccgcgccacgcgtcgcgtcatcgcgcgcccgccacgtcatgcgcgcgcgactcggggagacgctacagcccggcagctcccgagacacagctgttttggaaaatgctgcctgccttcaacgcctgtttctgactcttgcggtttcccgcatggctcccagcgagacgatcccgtccgggatcccatccggctcccatccggaggcgatcccgtgaaaggatcgcgtccaaaataaaagggcccgagacctatgcttatgtaattcctaatccgtgatcttttctaggggctgaactcccctccagcacagcctgttaccaggtgcttttcacaaacgccactggcggctgagttttcccccccacttccatttctactttacaagttgataacgtgggacgattacctaccaaatttcacatcatggcccagacatcgggtggattttgaggctctgtgatcgatttatacctatgctaaagttatcggtctgagaaagtagattagtggttgcctagggctaaggagtgggtttgggggtggggaatagaaaatgactgcttatgggtataggctttctcgtagcagcataaacatagtttaaaattagatcgtgttggcggttgcaccaccctatgaactgtatggtttgtgaattatatcttcataaagctgtttaaaaagtc

SEQ ID NO: 5876 - DNA, 2503 bp, Homo sapiens
ttcatagtttctatgggtcaggaatttggatatggcttgggtaagcagttctggcttctcatggagttggaggcaagtggtggctggaacagaaatggggcagccaggggtggtggccaggcatcagctacatctcctccatgtagtctcaggaactctccatgtaatctctctgtgtgggttgggcttcctcacaacatggtggcctcagggcagtcactgcttacatggcagctagcttccctcagagtgagtatcccaagagatcacagtcaaagtgcatagcatttatataatctaatcttggaagtcacaaaatgtcattcttgtgatactctcattggtgaagaagtcataaaatcctgctcaggttcaaaaagagggtgtatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttccttttttcatgaggccatcagtcatactggattagggacccactctactactgcaggatgacctcaccttcccaaattacatctgcaacaaccctatttccaaagaaggccacattctgaggtactgggggttataacttcaacatgaattttttggaggaaacaattcaactcctaacacatctctacccaacctctgtaggttccctcaatccaccaaaattttttggctccactggattatctagcagttaggaaaccaagatcattaaatgaattcaccgcaactacagtgagactgactaccttagcttacctctgtgaaaggagttaagccaaaggaatctgtggaattttggagagtttgggagcatttgggggcaggaggcaaatgttcttcctttaaatcacaacacttagttctcttccatttataagactcacccctccatcccaacccctgcaccacaggacaaggaagtgttcttggtcttcaactttcatccctgatggtgaaagcagttgctcctgacctatttgcccaccagcttctcctctggagcctgaggcttctgatgcctgcctggctggttctcagtaagaaggtcaagttcaaccagaggggagatgctgatgcctttcagtacttaaatatgagttcagaccctggggcctggacataagatttggggtcccctggatataagatttctgaaaacactcagactgtggagacccctgctgagggagaagccccaaactgtggcttcaggggaatgcaccaaggctctcattgaggccaccttctccaacaagctcccctcctgcttccccatggctggcatggctgaggaaaaaggacactgagcacagcccgtgcatgagcggcttgccatgcaacaggataaaacccataatgccactcagcaagccttggttgtaaatctagtttgattacatttgtaatcaaatgatggccatttgttctgtttctggtttgtgaaccaactgaagacataagcagggcctcagctaacccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatgggctgcacaccagaatgaatgaattgaattgaaagggaggagtgatggtggaaaaaaaaacaagtcaattcatttagactggtagaaccagaaccactgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtattttaattagctagtcttcatgtactggtacaaaagaacagtgtcatcttacagctgaagtcatagaggggaaatatcccactcaagatcatataacattccaggtactcaggatgaatggtttgaggactggtctgaattcttcaaaggtttcagctgtattaacattctccatctaataaactttatcttgtcattgc

SEQ ID NO: 5877 - DNA, 5396 bp, Homo sapiens
gagagacagagtgagtgagtgagagagagagaatgtaagcacagaagaagcacaagcagcaacagcagcagcatcaggaagacacttcgagcaaagacagccatcaatggaggctccactcaggcagctcaagtgaatatgccagcatcctgaggctgtggcgactgctcaaagacactgtggaatatgtaagataccagggaaccaccatgggcgctctgcagcagacctgaacaagtcagtgatgatggaaggggctgaatggatcagatccagaaacaaaggaatacacaggtcaggagagaaacaagtaaggcaacagactctttatttaatgtggtttaaaatacatcaaaatcaagtccctggctgttgtgaatacccaaaggagacaaaaaagctgccagtgcagcttcaaacaagtctgagtggccgggctgggccataaggaaagcagttacagggacagaaggcagctcccttcccccaggaagggcaagaggagcaggtgcctggctgtccctggggtgaccacctctgtgctgtgcaaggcggaaaggctggggcagcagctggagaatcagctcagcaggccttggccctcccccgtggacaccaggcagctccactggcctccgggtcagccctcagggccaccgtgatggggtggaggagggttaaataaccatctttacagaaataacagtctcctacagaaagtgcctgagctcagcccatggtccgataacctcatggaaaacaaacaacaaataaaaaaaaaaagtgctgctgacacctctcagaatctggtggacatgaagctctcagctggacaaggccctgaaaacaatttactattagcagagccatgcgctcttgagcttcacctgctgtggtcccctggaggaaaagctagcaatctaagaaaccaacacagatcttggtcctaaaactgaggtcacaagtgtgggacccacccaggtgaggaagacactggccttcactcatggataggcacctcccctgcatctggcccaggacctgggctactttggaaagcagaagcagagcagctgtagtgattggttgatttggtcaatgaagagaagaaaaaggtagggaacctcatctgcagactggcctgaaggtctagacatggatggagctgtgagcaaaggctgcaccttgcctggggcccacattcctgacctgggaaacccagctggggccacctgctcactgtggcctcctacaccaccacactgggatccagcagctccagtccctccacaggcattaagaggtagctgaagtgtgagtcaggcaattatgtgggccactgtaggcctttcccctctcttcaagggggaaggtgcatacctctgcctcttccctgcacctctctcgcctagcaaacactctgtgaggttggcagctcttgtaccagcttagcctggcacaggggctggggtagggaaaaggccctactggagcaggaagaggcaaggactactccagacagagggattcaaaggggaagaaaaaggtcatgggaaacacttcacaggacagcagtatctcagccagagatggcagagatctcaacactcacacagctgcttgagggcacctagatgtgaaggatacaccagagaatagcaggcaactctgatgcagatcagtggtacctgccctggggcaggagaaggagaaatggtgtgccattcatttgccatctctggtctcagtcacacatgattcagtacttaacattctttgtgaaccaacttatctgagagatttaaggtaagggctaaaagagtgggctaggtatggaagatgaagggacctgcaggacaatgaactagcttcaaagaaaaacagcaagaagcaaagccctaaccatcctatccatcttggtctgagtcattctgttgtcccagaaaactgcttggcacaaacactggctaataccctggcaagtttgcaacagcagaacattcagcatatagaatggctctacacagtacatagtagttatgtactggagtgggggtagaacaggacacagaaacaactgtctgcagccattttatggatttctggggcccagtcaatagttcaatttcatttcttacctgttagacaacagctatgggctcccacacaggaagaagtagaatccccaaggacaggcagggaggtgccaggaaatagaatcaggacaaatcttgaggattgcacatgtgggggtgggggcaggaagcagaaaaacccatgaagccaaagaggcagctggacatgggacccagcaactgctgcatggagacagtgctgatgggaactggtggtggcctctcaggactgaaacccacaggtaagcttgtggcaaagccatcagaagccctttcctttcttttaccacaaacaacctgatctcaccaaacaggaaacctcagcatcaagatggcaaaggagccaagtggggtggtgaaggaggtgggacactggaggccaggcacccaggcaccactgctacagcatccctcttccttggaaggtcctcaatacaaacactgtcatgtgcaaaaaaaaaagaaaaagaaaaaaaaaaaaaaagaaaaagaaataaagaaaaaaacaccttcagaaataatcctttgggtgatctcttgtcaatcatttgtgcaggctagagaggcacctgtgaatgataaggctactgagaagcatcattggcctggtcctggcactaccaaagggcaggggaagcgatgcccaaggggctcctgaccagcacatcatcccacgcaaaaacattctccaggtcccttgttccaggcaggaaatccccagctctgagcgccctgccagggctctgcctagggacaccttttccaggtctagagaatcaaaggagcctccagagcagctaggagggcctgagctgaccaagcaagccctgctcacaagacaaatgcagtcaagacctgggtgtattacttgtcttgagctctgaagggcagggaggggtctgagcctcaaatcagacagagaaatgctcaagtcacttctgccaactcactgtgatggcagctacagatgacagcccctctcaagactcttcagctcacagacaagccactgacttcatctgtacacacccccatccccaatgcaagcccactgtacacttacaggtataaatgcatttgcaaggccttgcaaaatgccctatgtacgtaaaactgacccacaaaatccaaaattgcaagtgccagatgccagccaggtcagaacatcctggcttcagcaatgggctgctcagcatgggagccttttatgggccaggcctggctgggctgccgctcccttcccagcatgacccaacaccaggctctctaggccctggcggaggtgggctcttgaggcccagtctggcctgatgcttctgtgctcggtgctcctgggtagcaaggcgcttctgtgaccctgggggagctgggtgcttgagccccaggcccctctggcctcctctcagggccactgtcagtgagggagccctggccaccagcactcaggtcctgtaccctcttgttcaggtcattgcgctctgtctgcagtgcccggcacagcttctccagccgttggatttttacctgcaggccctccagttctttatcccggactgttttctagggaaagaaatgagaccttcagtgccgtgccccatcaacctcccacttaccatcaccacttggcggcaaacactttaacaaggctgagagcagaccgagtccaaagctggccccctctaggaaacagtcctagttgaagccatgactaggctgtcaggtggggcagcatggtgcagaaaaggggcacggcttggagataacgtattcctccatttatctaccacgtgaccttggcaaaggacttgacttttgagcctgtctcatctataaaacaggactactaataccatcctcagagctcaagagaaggttcaatgaacaacgtacctaaaaacattcagcagcaaaaaagacaaaaaaaacccaaaaactttcagcaaggtctggcttgcagttgctgctccatcgttagttcctttcttctacattacaagctgtgaaatcacaaactacctgggctgctttacatgtaaaccaggcacatcactggcacccgtttttttctgctcttttattcctttcttccatttgctcccttcactcccactggagacctaccactgggctcaccacctcccatggggagagaacagcattaactttggacttggacattgtgtgcaaatctcacctctacctcatgctagctgtgtcactgatgggtagaacatacaggaaagggcctgatatgcgctaagtgcacacccccaccctggctgcagatcacagacagcccacctcctcagccatctcaagcagggccttgttgctgctctcccaccgggaccggtacatggtggtttctttctccagcttcttgatcttcttagtcatctaggttatgtgacagacagaaggaaatggtcagagctggcctctccaaggtctgtgtctccaaggtggggactgcacctgtgtctccaaggtggggaatgattgatcccaaggcgcaaggcattacaggatgcagtcaatgccctctgtgccacctcaccaccaggaagtcagaggtgtccaccaccaataacaaggaatggtaaggggccaggcatggtggctcacgcctataatcccagcactttgggaggccaaggcgggcagatcacttgaggccaagagttcgagaccagcctggccaacatggtgaaaccccgtctctactaaaaatacaaaaaaaaaagaaagaaaaaattagccaggcatggtggcacgcgcctgtaattccagctagtcaggaggctgaggcaggagaatcacttgaacccggggggcaaaggctgcaatgagctgagatcatgccactgcactccagcctgggcaataggtgagtctccatctcaaacaacaacaacaacaacaacaacaacaacaaaccccccaaaaaaaccaaacaaacagaaaagactgccccattccctgggacaacctggagtgtatacataccactgatactgcctcaagaggggaaaggctgtgaaccttcctaacagccctgcccttgagacaccccagatgggagcttcctgaaggcaggcccaacaattttgaatgaagcagcttatgccccagcagccatgcctggcctggaccacagttaccttttccatctcctgcttgaatgtggtgaatacctcgctgcttttggaaagtgtgttctggaactcctcaaacttctctgtgtatagggcaagctgtggg

SEQ ID NO: 5878 - DNA, 1390 bp, Homo sapiens
gaggaaaaactgaacgtacctctcagatataggctcttaatatactcttccctttcctcctgctacccccatattttatgagccaagagaaatgcccatgagggtggaggaatgtggggatttcagtctatattaccctaccattaaaatcggtaatcttgatatttaaaaaacccacagcaggagttgtatacatagttttggtgattcctgttagcgttttcaagttaagactgcctgagcctggcctttttgctgactgccaaccaacgttacctaaaaacaaagacacattgttgccaggccctttactatttatattctctgctcttccttgtcttacaaatcttaagtttttcaaagacagctagaagccctcatactacttgccaaataactaaaggtttattgcatggcattttgttttcatttccataaagtttgtctcctaatccttatctattaagaaatttaaatttttctcaggtacttggtaaactacaatatcccagttaacattaacttccacgagactcctacaaagaccacattatgctatctagagtgggttattataggcactaaatgtactttcaactcattttgaatactcaaacttaccagctctagactggtggacgtgttgctccaaattgattgcattttaagttgcaaacttagtttttggttcctaaacaagaatgcccacttttcctgctgtgtcaaattatctgctcagtaatacaaggcaaggccgaggtgggaaaacttgcttgagtttaagaccagcgcttgagtttaagaccagcctgaacaatgtagttgtaccccacctttataaagacaaataaactctaaaagcttagtgtttgtcaaacgcacagaataaacaggtgatgtaggaaaattttacctgtattggcgacacttctcccatagaatacagcagcacccagcattaaaactcttaattgaaatcattaagtggctctgaaaagagcctttgggtttgaacatgcgtgcttggccagttccccaggcagcagcaggcgcacggctgtctggatctccctggaggtgatggtcgaacgcttgttgtaatgagccaggcgggaagcctcgccggcgatgcgctcgaagatatcgttgacaaaggaattcatgatccccatggctttggaggagatgccggtgtcggggtggacttgcttcagcaccttgtaaacgtatacggagtagctctccttgcggctgcgtttacgcttcttgccatccttcttctgcgccttggtcaccgccttcttggagcccttcttcggggcgggagcggacttagctggatcaggcattgcaacaagataaaggagtaagaatacaccccaaagtgaag

SEQ ID NO: 5879 - DNA, 577 bp, Homo sapiens
gctaagaaaaatctgtatgttgattatgggtgccaagttaagaaagtattgactaagcctgggtctcaagaaataaaaagcaaacacatgtacaaaaccccaaaacagctatcaaataggctgacaaaaggatttggggttaaattagtccctcccaataaaaggcagagtacccccaaatggtacaggagggaaaacccacctaagtctgggccaatcagttgtcatgtaacctagaattgacggagactaactgaccctctgctctgggttgtggagatatcaaagcaggaggggttaaagcaagagagaacttgtaacaaacaatgtagtagagtaggtgggcagtgaacatctctgaagggcacttcctccttgccccagtaggaaacgcagtcaagctgggggcaaaggaagagacccaatgacccctcgaagagccccacaaaggaaaagaggggctcctttgctgctactctgcagtaggagcaggttgaatgtttgctgaacacatttgaaaaaggaagagagaagataatggtcctaatgaatgtgcaggagacaatagcagctccag

SEQ ID NO: 5880 - DNA, 5179 bp, Homo sapiens
gccgcgtccggctccaagcctgcgagggtcggctccgttggtccgctctgcggaccgccgtttgcggcctgtgctggctgctggcgacccgcggaaggggacaggcaggccctgccctgggggagcgcacgtgccggcgggagtcgggatacacccggcgatctcacgggctagagccccagggaaacggggctgcgcgtctttgtcgtggaatgaagggaagtctgccttggagaggggcggtcctggccccagaaccagccgggggctcgcgtggggcggctggagcccagggagccggtgggaaagcggctccccgggatgagacagcgtccaggcgccagcacccccatgactctgcctcggggagactgctgggggcgctccgctgactcggacacccagcgccagccagagcccgggaggacatccttccatttccctcctacagcctgagcgatgagccccagtgggcggtgaagggatggggggtggggtctgagggagaagggcatggaggaggggctgacacggaggagagcttgagcaggcccaagaagacagatgctggctctcaggcgagtgtggtgggaggaaagccggatgtcacaggcgggggcctctggcacctgccagctacagggaaggcagacagccccgggagtggggagatcaccttccttctccagaaaacaacacacaaaaagactgagttcctggaggtgaccttgtgaagctgggggtgggaagcgcaagtggaagagccgagctctgggtcaggcagctgggccacgacctccacacccagggtagggctgaacacccgtgaatgtcgggggttgtctatgcgtgccctggcctagctcctccttagccatccgtggctggggtctagagcccctgcagggacagaggctgcttccagacatgggtatgccgcagaccacagcccccagctcccaagtgcagagtctcacaggcctgcccacgttggccccagccccacccagctcagcgtgtcctgtctcctgggggcctggaacggccctcccaggaaaggaagggtgtatgtacactgagctctagggggagctgacagcgcccattcctgtcctgctgcctgcattattccctgcacctagagcagttacctaggaggcttactggatgaatgcacctaattggactctagcgtgcactctccactcttcttttttttttttttttttttttttttttttttttgagacttgagtctcgctctttcgcccaggttggagtgcagtggcgcagtcttggctcactgcaacctctgccttccaggttcaagtgattcctctgcctcagccttttgagtagctgggattacagatgcatgccaccatgtctggctaattttttgtgttttattagagacggtttcaccatgttggccaggatggtctccatctcctgacctcatgatctgcttgcctgggcctcccaaagtgttgggattacaggcgtgagccactgcgcccaacctccccactcctctcccgtccacaccaggcactctgctgcttggcctttgggcactctgcagccacctgtacctgtgtgaactggcacttgcctggcggtgtctgtgatccacaggccccaggctcctgtagctcctgcccacctgctcacccacactgtctccctatctcccatgccactttggccacctgtccccagggcaggcatgaagcccctggtctaatgctccaagacccatttgggcaccgtggtgctcctgtggccctgtgtctcatgagaagacagctggttgcaaagccagggctttctctgggagggtctgtaggtgcaaggctcaggcacttcctgagacaggtaggtagaagccagggttcggccagggcccagcccagggtgtttgtgaacaggtggacttgggtgtggctgaaaaggagaggttgtaggaagctggccagagaatcagggcaagtgccaaaggtaagggggttgctcggcccacgggaaagcctctccaagacaggagtggaggaggcggtgcaggagggcacacgggctacctccttttctagtgtttgcagaagtgtttgggctgggggcagatggatgtaaggctatgggccccagggagtggtcagggctgaagatgaaaaagtggaggttgtccaagggttattggaggctgccccagaggagcggtcctgtgcctgagccctcagcgtgccacagttgggagaggagagaagcagcaaggaacctgaggaggggcagaaggtgggagaacccccacagtgcatgacacccagtggctgcgctcctcacccatcctcatcagccctgcggcaggcaggtgatctgtgtgaaagggtaagtctcttgcacgtgcagtggaagtcccagggcggcgctggaggtgacccccctccccaggtgtccacagagggcatggcactcatcaggcatctgcatccgctaacctagagaaaggaccgtgtttgtgggccctgcacagctgtgtccctcacacagcctcagtttcccccttgaaagctgggggcttcatctgcctgggcagggcctctggcctccacccccaccccggcccaggcgagaatggaaagccatttctggggctcagcccaggggtccctggcccttgagccatggctgtctctttcccaggatccgaggggttggggtgagaggaggcagctcacacagggccaggtgtcctggaacacccccacccaggggcttttagcctcggagccttgggctgtggctgtcccaaacctcactggccctttatgcggctgaaaggccgaggaggaaggcggagacagtgacaatggggccagtggcgggaaacggtccttagagaccccattgtgcaccccgcccgccggaaacaggcaacaagcaggaccctgcagaggggaccccacacccttcgggctcctcgccacgtctggatgctcagcacgtcgaaggggcctgaggacagaggggcccattcttccccaagggcgggacggggccaaggatgactctgcgggctcacagcagccatgggggaagtcggcaccctgccagcctgcagccccttccctcacaggcctggctcagagccggagcgctgtgcgcccgcctgcccccaccgtacccgagggaccctatgcccctctgcccctttcctctcctgctgagccccagaagcacctggcacgggaggcaagtgggagccagccagggaagcaggcaagggtgcgggcaaggacggggctggtgggtgcagcagagcagaagcttgcatgagtgcaggtccccacgtgccccccacccagcagcggcccctccccggaatgtgggtgtagctcctcctgacatctgctctccctctcagttgccaaatggtcttgaacaagataccattcccctgagcctcagtctcccgccaggaggcaggaattggagccatcctcacagctgcgaggcaggcccaaggctgggctggacacaggagaccaggtccacagcagcttgcgtgaacagagttcttattgatagtcccatcacctccaaagcagtgggcccaccctccctcctaccagcccctccccagcacccagcccctcagtgcagcgccacctcgcaggggtggaggtgggcagcacgggcagcctcgtaggcacggcggaactcctggaatcgtggggcacagcccagccgggcctccccaaagcggctccagcccatgaagaggaaggtgcctgggcccgggtggacgccacagcgcagtggggtacgaatggaggtcagcccctggtccccggatcgccccgcctggaacagcggcggtgtctggcggaggacacgggcggccaccacagtgatgacagactcctgcagctccacgtcatgggtgaccccatggatgatcccgtgaattactgtggggaggcatgtggctgcggtaggcattcaggggaaggcaggctccaggctccccccatggcggggacactcaccgaagtcgctggtgcatgcggccaggagcagctcagcgtcgctgcagggcctgcaggcacctggcatgcagagggggtggtgaggagaggccctgccctctcccggcatcaccccaggccccgtcccttgtccgcacaagcggcaggaggcagcaggcaaatgagcagagcccacgctcagggcctgatggcacctgggggtcccagagagctacacagcagatgtgcacgccctcggcgacacctgtactcaggaaacacacttgcaggcgcgtacctccaaggcaggaatgcacacagacgtgggcctgggggccatgcctagcgatcagctgtcctgggccgccctcctgcactcccatctgacatatgcaccccagcatctgggacccctctagtttcccggatctgaggtctgaagagcagcagcccagctagggtgataggaagtgggggcagaggaagggtggtctggggtccctggcccagggccagggggcagaatagcgagagcccatccctttcagggtcaggcgccaagctccaggagagccaagcaagagctgggcctggtgccctgcagggaggcgagcggcgtctccatggtgaccgggctgcacactggacttttgttggttgggctgggggaggggagagaggtcaccgctgggccagggagccccggacagctttggccggaggcttcgattctgtccccaccatctcttcccccaaccgttcagggaccagaggcccaggattgctgggcccggcctccccttccctccactctgcccctgccagctctttccagagatgaatcgggaagggagggcggggaggccatccctccccagcagtcccaggctgtgtggcctgacaagcccatccaacccttgtagctcactttttccttctgcagtggggccgacaaggcacattcccgccaagcccaggcagggtaagacttcgggactcccaccctgtcccaaccagaccgccactcaccgtctacgccgagaccgtgggcctgcgggggcagctcggggcgcccgtcctcgcgcagctcaaagcggaaggcggccacgcggcggctgatgtcctggtgcggcgtggcctgcaggaagagg

SEQ ID NO: 5881 - DNA, 835 bp, Homo sapiens
ggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttcc

SEQ ID NO: 5882 - DNA, 1298 bp, Homo sapiens
atccggagccaaggtccgctcgggtgagtgccctccgctttttgtggccaaacccagccacgcagtcccctccctgcggcgtcctccacacccggggtctgctggtctccgcggatgtcacaggctcggcaaccgccctcctgtcggcggggagtcccgcgacgcccggaaatgctccgaagcctgtcgctcagctgccagatctgcgtctgtgtccggttccgtcactgaggtcgcccctgtccggcccttccaccctagttctcttcaccgtccgcccatcctatcgcgcgcggcctcaggtccccattcggcatgtggcttgtcttccatcgtccccaccctcgcccctcttggcccctcagggcagccctgggattcggcagacgccagtcctccctgagatgcttccccgtccttccctccgccaggccctacgtctccgcaaaccccacgcttcggggtggccgcctcagacaggaccctgagtccgagactggggtaggggacctgcccgatcctgtaacaaccctcgtgcttctgcacaatcgcctcccactagcggtgactgttgggtgtctaccttcccggtgtcccactgagaagcgggctcctccttggcaggggcttcttcattgcctcgctgtggatgtcgaggtggggcaggagagtgaggagaaaacagagaggagggaggtagagccaacgagcgagaaaaggggagggaagtttagatgggaagtggatgggtctgaggaatttgaacaaacaccgacagtgaaggagagtgacctgagcaagcagtagtggggtaaatggaaatagacaaaatgggaatcagcagagatatggaggacagaatacaatgaggaggccttgaccgtcagtagcagagagggcagcagaagcctaattcccaaattccttagtggttttctgatttccaaattagtttcccttttaaatttattgtgtcaggttcagcttatgaggcctcaatacttttcagtcttaattgtatattgaaaatactttttgtttactaaatgctttttacattaattcagtgtgcactccgtaaggatattgatgatttgagttagtttagtattcaacagcttcctctattcctttgtatgatctctgtatttaatggctgtggcataaagtttccaactaagtataagtatcaagttttctttgtgatgttttctgcaaatattgaaggatgacctggattgtcctagaactttgttccaacagattacatgtgttcataacgaataaattgctcaaag

SEQ ID NO: 5883 - DNA, 8604 bp, Homo sapiens
gggccgggctgggcagccgcgaggtgggcgagctggcaggggtgcttgtggccttgggaagggccagggtcgcgatcagtgggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaagaaaaaaggaaagaacaattaaaaaaagagtgaaagctaacttttcaaaaccccagtattctagttgagtagcttacaggttcttttttttttttttttgagacagggtctcactctgtcacccaggctggagtacagtggtgtgatcacagttcactgcagactcgacctccctgggctcaggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggattgtcattgatggacacagctgggtgagaagacatttgagaacaggatctttactgatctcaaagtaccaccacacagatattttattaattaccaaagggaaaaattattttttatttttttatgagacaaagtctcactctgtcacccaggctgaaatacagtggcaaaatcgtagctcacaacagcctcgacccccaccctgggctcaagtgagtctccaaattcagccccccaagtatatgggactatagtcttgtaccaccacacccagctaatttttttttttttttttttttttttttgtatttttagtagagacagggtttcaccttgttgctcaggctggtctaaaactcctggactcaagcgatctgcccgtctcggccttccaaagtgctgggattataagcatgagccaccacacccagcaaaataactacaatggagagatctggaagatcaccttaaacaagtgatcaaacttagcattatgagccacctgcaatcacgaggcaggaaggatatatcacctatgcagtatttttcccaaaaatgcttaccttgaatctcatcatgtggaaacagacaaatccagattatgggacaatttacaaaacaactatctttgactcttaaaaaatgccatgtcatgaaagatcaaaaaaagtagaggaatgttttagattaaaggaaatgaagacatgacatgcagtgcctaatctttgattggattctgtgctattctttcatctttctggtatgtttgaattttttttgaaatataaacttgggcaaaagagataaccaagataattgattaatttattgttatggctcattgggggcagtttcagagaaataaaaacaatctttgtaactggagtaaattctcaaggttaatcttaagcaatatagcatggtcattaagaatacagattccacagccagactaggcttaaatcccagctctgtgaataatgtgaatttgggcacattgattaatctctgttccttggccttgtcattataatagtacctacctctaatgagttttgaggattagatgaatcagtacctgaaaaatgcctgacacacagtgagtgctcaataaatgttaactactgtaattattacattacagaggttgtgggggggccttttctgagtcctccaaaaggatgactttattagggccacattaagactgtggaaacagaagagtattcaacagataaatgaagtctatgagttgggggtacaatttatggagttttagattaaaactgcatccaataagttggtctgacacatctttcaaacctatagaggaataatcacaagtgactagtattcctttgggtccaatagaggtctctgatcttcatacagattgaatgtacccagaaccgtaacctagcattttacttatatagcaaccttaactctgacacaaaagtgtttcttttgttttgaggccaagtctcactctgttacacaggctgagtgcagtggtgcaatctcacttcactgcagcctctgcctcctgggctcaaatgatcctcccacctcagcctcctgagtagctagaactacaggtgagtgccaccatgcctggctcatttttgtattttttgtagagatggggtttcaccatgttgcccaggctggtctcaaactcctgagctcaagcaaccctctctccttggcctcccaaagtgctgggattacaggcatgagcctgaagtttaattgttattcttttcctgcccccgacttttgattttaaacattttctttttttcctttaagccttaggatggctaggaagcattttcagatggtataatgaacacctgtataactttcatctggaatcaacagttgctaatactttgccacatttgctttccatgtgtgtatgtctatacattttctggacaaaccatttgagagtcagttgcagacaaaatgaccctttgccattaaagacttcagtgtgcagcccctaagaagcaaggcattctcctgcataaccagaggactatcatcacccaatggaacttcatattatcattgtctactatgcagcccatatacacattttcacaattgtcccaatcataacatggcttaaaaaattcagaatccaatccaacatcagacattgcatttagcgttcatgatttttttttttttttttgtagaaagacctttaatacttctgtttacaaaattcaggcatacatttcagtttgccctgaaccgtgcccaaggctgtgtgctcatctctgccaggatgtctgtgccctcatgtactgctgacgtggagggtgcagagcagagcctggggtctggaggcttcgctgggcctcagggggaggggaatgtgaatgtggcccggcccagaggaccctccatttcatcagttttggattgggcaacagaggaagcagatgtctgggctgcagacctgctggtctgggcaggggtttgggaaccccggggttgcctgccatggtctagaggagatggctgcggctacttcccacagggtggggtggccactaggggcttgaagatttgctcactggagcctttgtgcttggccctcagcagcacagctggggctgtggtcccgtgcaaggtgtgctgagggttgtgtaggtggctggtggtggcagcttgtgccagagtgacacaggcttctgtgggcctggctgggggcagttaaaaagccgaaaaggtacttggctttgtgagggcaaggcttgggaggcggg

SEQ ID NO: 5884 - DNA, 4834 bp, Homo sapiens
gcttccattttttgggtaatcatgtataaagttgcaataaatatttgtgtgtaggtattcatgtggatttaggcttttaactcatttgggtaaaatacctagcaagattgctagattttcagggtatgcataagtttagaaagcacataagaaactttcaagaaagtttgtaagaaaccccttgactggttccaaagtggctctaccctttttcattcccaccagcaacgaatgacagttcttggtgctccacatccacaccagaatttggtattggagacaagtgttttaaagacatagtttgattgaatctgcggatgtggtagatgtgggtgggagatgtaacttccatctgtgtattttgacttaagtgagaaactgaactgggctggcaaagactgaattgacatcaaccaaatcctaattttatagccaggattcttcatttagatatcctcattcaagtttattgtttggccattctaatgttaaatttcaggatctatcttaaacaaaataaggaaaatgatagagttttccatttctgggctattttaaatatatatggaatattcatgatagtgatagtttatttagatttccaaattggaaaaccaatattaatgaaaatatatagtgtcttaacatgttagttaaattttagtgtgagactcttaacctctctgtatttagttttctgacataggaaaacctttaagaaacctctaatatttctttcaggtcagaaaaactggcctcatagggttgtaaaatagaaaattcagttatggaggtatgtgaactctaaattttctatgaatactggccaaatacccataacaagtaaaaccatcaaattcaaacataaaaaaccctcttccaggtgtaaaatggcataattatatatttataatttataattttctctctcaattagagatgaacccaaacatactcgtagacgtctaaccaattatgtaactttgggctcgtcacttaatattcttgggccacagtttattcatcttgagggtggtgaatcttcctgttgccttttagcattaattaatgctttaaaattctccaggaataacaagaggaatttgagttgccacagtgtgacagaagtaaggtagagaaatattatagtgattgtttattcttgtacacttttcaagaagtgctaacatcttgggaagtcagatatttatgttaaatttttatttttcacattgtatttctgccattgacctaataaaactaagttctttacaaatgtctttataattcttttttcaaatttagtagttttgaaattcttcctgatccagccaagtcatccattaaattttactctttagggtatcagtacattgacaaggcatataactcctttgactaggaatttgagtggatacagtgttttaattggatgtaatcatatatgatgtggtaaacttgtatcccacttttacatcttctgtggaaacttgaaacattttctaactcagtagatgttttataatttccatttgataattttgatagttttgcttatgtggaaacatttcatgggagacatttaagttttgtttgataatgtatagattcccatagattttgatagctctcataatgctgactattcacaatgaggtcactcattctgtgtattcttgcctgcattttaagtgtccaagtgaattttgttcactgtcctaaatgcaaccctaagacaaaatttattggtttctatgctgatatagcatatccttaattggatattactgttatccttgttctgtttactgacaatgttctgtggccagctgtgtttatgcagaatttacatttgataaatgtttcataacaattcataataatgtaccattcttggtacaccataacaggcacataaactttcgaactgtgtttctttttctagtaatatatttggacacattcacttctaggttcccttaggattccaaatgcaaactgagtctaaaatgtgccattgcacatggagctctgaggcattttgctctacagaacacagaagagtcttcttagcatgttttcatttacagagtggcctcattctgaatagtcagcattatgagatctattgatctatgaaaatctgtacattaccaatcagaacctaaaagtctcccatgaaatgtttctacataagcaaaacaatcaaaggtagttaggcaacaaagtatatggtttagtagaatgactccacctaatcggtatgacaacgctggttactgggaatattataaattcactacagaattgtttctttgattctgtaagtagctcactagggacattactataattgagctaaaaatgaaggacagtaatagtagaaacagtaatttggagttaattgacttaatcagtattacttcatgtgattctgcccgctttattgaagaaattgtgctggatgagtacatgaatcaaaatgcatattttaatgttcctgcacctctgttgtgtcaacaataaatgcggattgttatacatttaaggggagatgagaaaaaatttaggtgtcaattctgaactgattgctttttaaaattttagttgattgttaatgatgaatgagtagcccgaattttaaagcaattttacataaatgtaataaatagaaagataaagaagtaaatggcattcaatacatttcctagttacttaggtcctgtgtagaaggagagaggtagaaattatagtcacataattgtatatgctactgaagtagatatttagggcacagtgaaagtcttttgccttgagagtagataatgatttctagtagagaaaaggcatgagcaggctgcatgcctcccccgactgatacagtaaaccttcatcttttatatcatttttcccaaattgttgttgttgctggtgctctgttgttttgttctttttctttctttctcttttcctgcaaacagttcaatgtcacactgagttggtgctactccagctgggtgtctaaaccattctgagctgacatttctgggaagagtaattcagtgatttctgacaagcataaagcttgcatgtgtatgtgtgtgtatgtgtggagagaaggtaaagaacatgtggagaagtctgtagtttgaagcatagagaaaaggagaaactctaagtattatattacttaaagttttagtggcgcaagtaaaaatggatgtgaaggttgtcattgctaacaaatgtataattgataggaggcatttctatgattttactggcagtttcatcagttaaccattttaatagtaaaatttatttcttctgaaaagtgtgtattaatcagctgctctgcaaggtctggtgttggccactgtgttttttaaaacactcagatgatggccgaaggatactgagattttccctatttttgaactgcttgagtgagccagggtgctacaacccattttcccctcctacacactgctagacaaccactggaaaaaaagtcaactgaggtggaaaaaatagctctgcctttgatagactgtgaagaaaataaagattaacaaaagctctggccagagaggaaaacatagatgttgccttaacattaacattaatgtcatttcagagcctttgaatcatgccttaataaccagtgttgtagaaaaaataaatgacaaaatggggtgtgtgtgtgtgtgtgtgtgtgtgtgtgtgtgtgtggtggagggttacatgttctgtagttaaaaaaagtatttgacatagaaaaattagctctagaagaagctagcctgtatttaaaaggcttcaggagcatccggcagaaatatttttctccattgactgtttggctaaacaaagaataatttgtaatctgctccattaataaagtgcctttccccttaaaggactacagatcactatgcttgctgtttctacttgtgttggttatttacaagatagtgtaccaaaaaacattttgcaattggtacgttgaagatacatggttaaaagttgaatcaaaagcaacagcagccacaataataacaagagcaacaacaaaacaaaagctgcaaacaaacctactttctttccttatgttactgtatgacatcattgctttgagtaaagaatacagtagtattaatttaaatgcttaaatttatatttatacaaatgttgatagcatggtcattgaaatagttttgcaagtcctcacaggttttcagtttaccatataaagagattgatctgtatgtgtaatttgtgctttaagtggtagttttaatagttactggacctcacagtttaatgggcatgtttataatgctacatcaattaccacattttctcatagttctgtatattgtgagaagaaaatgaaaaaagtgctgtttaactaagtacaggaatgtggagccaggaaatctcatgctctgatgccatttcttctcccagtgttctttgtaactttggttggcttcctgactccaatttacattttttcagttattaaattattttctggttattcataacattttcacctcagacatttcaatgtcacaaatgaaaattaagttgtttcagactaaatgctactgttgctacctcagtctgttaatatttcaactttagtagtagtttctatagtaaaaatattgtttttgttattataacaattatttgcaagagaatcttaagaaggtttgtcttttataaataaattatactatattggatatctatgaaatatgtaatgatacatgaaagggaatggcttatattcatcattaaaataattttacatttaaaaaattaa

SEQ ID NO: 5885 - DNA, 8356 bp, Homo sapiens
tttcagtggtccttttttaggtagttatatttcttgtgaaataacatttatctgaacattagtaactccttcactgtcattttgctctcattttcctgtctttatagcaagtaaaattaaatggagtaatttgaaataaattatataataaatggcattaaaataaccccattttaaaatattgaggtataatttacatacattaaaatgcatcataggtgttccatttgacaaaatagatcacattttctttactcctgaaaatttccttgtgctcctttccagtcagttctcctcttcccagtagccactttgtggtataatcccaggttcccaggttaatgaaattatttctaactgtgtttttaatacattcacatttttcttgctaaattatatgccaaaaaatgtccaataaatgttaagctttttaggatgatggcagtttgggtaattcattgctttcttatttatacttttctgtattgtgttttgttttttttttttttgagacaaggtcttgctctgtcacgcaggttggagtgcagtggcataatcatagctcactgcagcctcgacctcccaggctcaagaaatcttaccacctcagcctcccaagtagctgagattaccggcacttgctaccacatctggctaattttgtgtttttttttgtagagacagggttttgccatgtttcccaggctggtctcagggactcctgggctgaagcaatctgccagctttagcctgccaaagtgctgggattacaggtgtgagccatcatgcctggccttttttgtattatttgattttttattttaggtagtaagtcttaggttaaaaaaatcaaaacctgattattaattaaataagaaaagaatattttttaaaaaggcaaatgcttcaaagcaaaactgtcttccatcctaggaaaggtatgaaccagaaaagagcaggttcaaagagaaaaagggtatgaagtgtttcttagattagtgtttgtcataattttgagagctgatgatactaatccctgaaatagagtaaggaaaattgaaaaaaataaaagaaaaaaagagctttgtagttatatggagttggtacctttctgtttgttattatatatgaaatattgtaaatttctggcaccaccaatcataacatttaagtgtattccagagctgaatataaattattctatttttcaagttaatatatagtgttgtcagtatatgttgaatgaaattgccccttaagttttcatttacatcttatatttatctggttttactaattaatttattctgcatttttactgagtgtagcctcagtaaaaaccctaatgtgggtaggcactgaaattgttatttgaataacacatccctgtttgcagtgtgatatgaagaaggggaacagaggttcaaaaaaacagagaaagcaaatagaaaataagtaaatgggagtcttaagcaactatattgttaatgggctaaacacttcaattaaaagtcagagattatcagaatggattaaaaagcaagacccatttatatgctatcaacatgaaatttacttaaaatataaaagtacaggctgggcacggtagctcacgcctgaaatcctagcactttgggaggctgaggtgggtggatcacctgaggtcaggagttagagaccagcctggccaacatggcaaaaccccatctctactaaaaatacaaaaaatcgccaggcatggtggcgggtgcctgtaatcctagctacttgggaggctgaagcaggagaattgcttgaacccgaggggcagaggctgcagtgagccaagattgcgattgcgccactttactccagccttggcaaaagagtgaaaatccgtctcaaaaaaaaaaaaaaaaaaaaaaaagaaacccttgaaggtacagataagctgggggtggggtagtgctattaatacatacaaaatagaccataagacagagtattatcagaaataaagagggatttttcataatgttaaaagtatcaattcatcagaaagcggtagcaatcataaatttatatatgattataaacatatttttattaaaaatatataaagtggctgggcgcggtgtctcacgcctgaaatcccagcactttgggaggctgaggcgggggtggatcacctgaggtcaggagttcaagaccagcctggccaacatggcgaaacccggtctctactaaaaatacaaaagttagctgagtgtggtggtgggcgcctataatcctagctacttgggaggccaaggcaggagaattgcctgaacctgggggacggaggttgcagtgagctgagattgccccacttcacttcagcctgggcaaaatggtgaaactctatctcaaaaaaaaaaaaaaaagtatatatagcaaaaatcgacaaaattaagaggtaaaagatacttttacaattagtgctgaagatttttaccaccctactctgaccaattgatagaatttctagcaaaaaaacaaaattagtaaagacatagatgatctgaggaatactacaaaccacctcaatataattgataagtattgaacactacttccccgaattgtgaagaagatattcttatcaattgtacatcatatattcaacatagaccaaatggtggaccatgaaatatgccttgataaattttttgtgtgtgtcttgataaatttatttatttcttgagacagtctcacttgctctgtcacccaggctggagtgcaatggcgcgatcttggcttactgcaacctccgcttcctgggttcaagctattctgcatgcctcagcctcccgagtagctggtattacaggtgcatgctaccacgcctggctaatttttgtatttttagtagagacagggtttcaccatgttggccaggctggtctcaaactccagacctcaggtgatcctcccacttcagcctcccaaagtgctgggattacagatgtgagccaccatgcccagctggtaaatttaaaatgattgaaatttatatatgttctgtcaccacaatggaagtaaaattaaaatagaaattattaaaatatctaggaatgatccaaatatttggaaattagacaacacaagtttaaatgatcatgagtcaaagggaaatcacaattagaagacatttttaatcgaatggtaatgataatataatgtcaaaattcatggaatgtagctaaagcagtgcttggagggcaaattatagtttaaatgcttttattataaaggaagaaaagtctaaatgtcagtaaccaaagtttctaccttaggaagctagaacaagaacagcaaagtaaacctggagtaagtacaagtaaggaaacaatagagtaggaatcaatgatgtggaaaacagataatagagaaactttaaaaagccaaaatctggttctttggtaagatcaacaacagtaataaacccttatcttcagtgaacaagaaattgacaatgcgacatgttgtaatagtaaaggaataaagtacatagtgtggaacacagaggctgatctgaatttggttttcaaaggtggtttcagagaggtggtaaaatttgtgtttggctttcaagaattagtgtaagtttttcctgatacagattgggaaaaagaatattctgagaggaaataagagcaaaataattttatttttcaggcttttggcatatttagaaccgtatttttatttttttgagacagagtcttgctggagtccatcggtgcaatctcggctcactgtaacctctgcctactggttcaagcagttctggtgcctgagcctcccaagtagctgggattacaggcatgtgccaccactagccccagctaatttttaaatttttagtagagatggatttcttcatgttggccaggctggtctcgaactccaagtctcaagtgatccacacgccttggccccccaaagtgctaggattactggcgcgaccccacagcacctggcctagaatggtatattgactttatctgtggcatatgggttatgttaggtggagagcagtaggtgatgcaataggaaaagcagtttgagtctagagtgtacagaacctagagtaccttccttgataacttggactttattctgtgtaaaatagcaagcttagcgtctaaagtttttaaaggagttttttaaatgaaatatttcaaacagaaaatacatagaatgacatactgaacacttattaccgctaccctgctttaacaaatcttataccttactatatttgtttcagattttaagaaattaatacatcatagatacaattgaagctttgtacctttccatctcataccaccatgaagttctattctgaagtcatatatccttaccatgcatttttaaaatacttttactgtatagctatatactaataaaaaggtggcattctccatgttattaaagtttcttaaaaatgctatctatattttacttattctgcaacttgtttttctcacttattattatttttgacttatgggatattccggaagtttggactggtgtaaccacagtagttatttacggccagtgtcctttcttctttcttttttgagttaaccaggatacatttattaaatatatccaggataaatattcccaaaaacaaatatttggtaaatatggcaaacttattctttggcaaattagcttttagcatgttggactgctttccatccctattaggagtattataaggattaaatgaagtattaccaacaaaaaggtacttagcaaaattctcagtaaacattggttataatccctccaacattcagacttaagttctgcctattctctttcctcagtattctttattcctgtccatataaccattgtccttttgtaggccttcactaccttaatgtggactatagcaatagtcacttgattggtctcttggcttgttcccctccaatcttgttctctacactactgcaagggtgatctgtctaccacatagattttgaattatcatctacagtagtaaaacagttttcatggcatacaagcttcaataatttagtctagatattccgcttgatctcttttcacctcttttccatttatcttctagcaccactgcagtgcttgtagttccttaaatatgctattctttttgaaaaagcagcaaatctctgtgcagttgcctttctaactggaatatcttcccccttcttgtgttctcacaaaattcttattcatctttcaagttctagctcaaatgccacttccttgtaaaggttttcctgatttccttaagcagatttgggttacgtttctagggttctgctgctctttgtacatgcttctattataatgcttatatatattattgtagttgttttttaattttgtctgtcattctaatagactgtaatctccttgcaggaggagatctgtcttttcatcatttatataataatgactattgtacctagaatataagtcattgacatttgttgaattaaaaaaattcagaaatctatttacagccctctctactgccttcccatgacacctccattttacagatcattaagctgaagcccaatgaaatgaagctatttagtgagaactcatgcctcctaactccagatctattacttttattcttatattgtagagaatattctgtttagcatgtatatactagttatttatattataagaaacagtcttgtcagtattcttcctttcatctctagggaataggtagaagggtatagtgattttatgagatttgtgtttttttttcctgtttcaatcattcagatgcttttgttttctagcaaattcagcaaaattcaaggttttcttcatgtcattccttttctttaccctcacagaactcaggtaggattgaatgtctgatgcatttagtccagttgtcctcaaccaggggtggttttggccccctagagggcttttggcaagatgtttagaggcagttttttaaattgatacataatatttacccatatttatggggcacatgtgatattttgatacatacataccatgtgtaattggtttatctgtcacctcaaacatttatcatttctttgtattggtaacattctacatcttttagctattttgaaatatactttctgtgggtgcttcctaagcacccttacttataaccttataaccacagtacatttgtcaacctcataaatttacactgatatcatacttttgtctaaactaccttccatgttttataaaaatgttttcttaatagcatttttaacctcttcaatactggatccagtctagaagcaggtattacatttggttgtcatgtatttttagccttctgtcatctatggtgtttccacagccttgtaaaactgtagtacactatcccaaccagactattcacactgttacagtctagatacagaatggtttcatgataaggtagtgagacattttaagatatattccctgtggatttggcattcattgattacccttttccttgctcattctttaccttggttactttgcaactgtagtactcctgctagatttactagtcaggccttagcaaaatactgtaagcacaagacctcccttctcccttatttgtttagtaccatgagggactcatattcctacccttttttttttgagatggagttcgctcttgttgcccaggctggaatgcaatggcatgaccttggctcactgcaacctctgcctccccagttcaagtggttctcctgcctcagcctcccgagtagctgagattacaggtatgcgctaccacgcccggctaattttgtatttttagtagagacggggtttctccatgttggtcagactggtcttgtaggagaaatagacttcactaaaatattacagccaattagtaaaaataagacagtaaatagtaacaccttgtcctggagtgatagtagccagtattgctaccatatattactgacaatgtttaattttcaacaacaaaaataattgagagataaagagaagtaagaaaacgtgaccttatggggaagaagactggcaaaacatctcaactttgaaggcataagatgtgttactaagcagacaaatatttcaaattggccattataaatatcttaaaagaactagaggacaccatacctcaggaggcaatgatataattacaataattttgcaactagagaatataaataaataggtaagaattatagaaaagaaccatatggaaatctggagttgtaaagtataataacagaaattacaattcattagagaggtttaatactagattttaactggtagaataaacaatcattgaatttgaagatagattgatagaaatcacccagtttaaaaaatacagaataaagaagtaagtaaaatgcagtttcagagaaatggcagaagccattgagaataccaacatatgtgcagtggtagtgccagaacataaggacaacgagctgagagaaaaaatatttaaagaaataatacctgaaaattttctatattatgaaaaaaaaatccaagaagtgtaaagaatttgaagtataataattgcaaatatattcccccttagacacatcaaagtaaaattatgaaagtaaaaaaacatcttggaagcatgaagagaataatggctgatatacaaggaaactctaataatacagtaataattaaggccacagtggaggtgtatgacatattaatagtgtagaagaagtaaattcaaaattttacctgaagcacgactgacattcttaaatcaaagtaaagacattgctagataaacaaaaactgggaatgtgttcttagcagacccaccttgtaagaaaagctagtttttgagaatgaagaatactgaccccaaactgtaattgaaattcctatgaaaaatcagagtaccagtcataattatgtaataattatagaggctagtataaatgcatattttttatgtattagctggcatatatgcctatacactgtatacttataaatattcatatatgtgtattgtgtgcagtatttccatatttgtatttgtgagcttacaacatatagaaatgagatctatttaataatatcacaaagtatgtggttgagaacaaaactgttgtaataaggaaatgaatcttttttttttggagacagagtttcgctcttattgcccaggctggagtgcaatggcacgatcttggctcaccacaacctccacctctcaggttcaagcgattctcctgcctcagcctcccaagtagctgggattacaggcatgagccaccacacccggctaattttt

SEQ ID NO: 5886 - DNA, 950 bp, Homo sapiens
ggggagggagaggccatatgagtggagggacctgtggaggaaaaattattattactaccttgatgtccgctgaaccaaagtggatggaaatttctcaggacatattcatccaaactacaaaaacaggttactccatactgattacaggatgatttatcacacattcattaaatatagaacattgactagcaaccagtttcctccaacaacagatccatttggaaatggcacactgtagaaggcaatcttgtgacttccttctagttgtatataaaaaatacaaatcggtcagggagtcaggtacaaaacagtggtacaaaagcatgaatagatacgccttatcaaagaatgtgctcatttcatattgcagaacttctatctagattctgatttttagaaacttactgctggttcatttgttcggagaggtttcttcacacctctcttccactcctacctccccttgctaaaatccactgactgaagaatacttagtatggatccacatggaaccaaaatccccaactgaatggagtcacatgcatcagcacagtggctaccggtttcatctgctcacccagcctcatgtatttagggactgaattcaagctagaagcacccaacacttttgtcttttggaatctaatccaagtgccaatgtacatctaaaagtcccatgtataggaatctcttgattcctacaaatgagattcaagggagagaacagtgaggaaagcccagagagggggcaggagactggccacaagccaggtctacttaaactttgaaagatgagattgttcaaaaatgacacgagaaaatcacccatcaccactaagttaaagacttgaatatgtgagagttccagagcctcaaactcctactacagtcactgatccataacattttcctcttgcaatggactccacgccaaagtagctcagtcttgc

SEQ ID NO: 5887 - DNA, 7038 bp, Homo sapiens
gaaaagtcaagatttttttttttttcctttaggctgggaagactaatcagagagactgcgaagtaaaagggttgtttatgattcaccatcaaacacatgtctttaattatcactctgaatccacataacaatattcctttttggcacaaggtctgtactagatgaatgataaaaaagagccataagtgtgtaagtgccataagtgtgtagtattcagagacagacaagatcctctctagttgcagtggtcaaaaagtcttatcgagtaggaaggctttgacatgaaccttttttttctaagtttaaaactattttatttattttttcagagacagggtcttgctttgtcacccaggctggagtgcagtggcgggatcatagcagcctcaagctcctaggctcaagtgatcttcctgcctcagcctcccaagtagttaggactacagacatgtgccaccatgaccaactacgttttaaatttatttttgtagcaacagggtctccgtatgttgccctgtctggtctcaaactcctggcctcaagtaatcctcctatgtcggcctcccaaagcactggggttacaggcattagctactgttcccagctttcatttggactttaatggataaggaagacttagagcagcattatcaaattctttggccttaggacccctgtataacactcttcaatattattgaggaccccaaacaggttttgtttatatgggttatatctatctgtatttaccatattagaaattaaaacagacaatttacaaatatttattaatttattttaacctaaattacatgttaacataaatatttttatgaactatatttccccaaacaaaaacagttagcaaagtggtattgttttacattttgcattttaacaggagacaggtgggttcttatatttgcttccgttgtgatactgcatgtcatgtagcctctggaaaactctactgtacacctgtaacagaatgagagtaaaaaggcaaatagcatcttagtattattatgagcgtaccattgacattgtgggcccccgagaagcactctgagaaccactgattaaaaaagactaagggcaaaatagagggatggcataattttaaaggtaggagggtataaggcatgttacagagagagcaaacagaccaatctggtagttgtgaaagattcacatgggggaggtggaggagatatggctagaaatgtatactgggggatcgtgttatatcaattaaaaaatactagcttccttaattatgaccatcttcactgacctctaattttggcatcagtaagcttcagggtaggaatgatagaagagaaattcatattggtttcaggcaactctaaagttatgtggctgacagtattctaattgatttgttgattgctttatctatttaatgtatttagtgtttactacattcaaagaagcaacataagaactagtgatacaacgatgataaagacacagtctctactttataggagctcccaattgagtggaagattcagatattaaaataagcaatacactcattaatctggaggaagacagaggagagggctgctaactgtgcctgggtggtgtcatagacagcattgtacaggaaacctttaagtcccaaatactaataaccactgatacatgaccatggtgagaaatacttgatgtataaggatgacagattcagtactagagttaatacagtagttctggtgagatagtcagatagtctatagaaaaatttcctgaatatatgttctcttttgaaagtaagagtgtacaaattttctttctcctaaagccctgcagcatctttctactgctaggcctgggagacaccatcagttatcttaatgtctctattttcttcagtttgatcacctttttaaatctttttgttctctgtgactcagtaacaagagtgaaggggaggaagaaatttaggtaattacaacagctttaaactaagaactgagaacacctttactaacccaactaattatgattaaatacgtaaatagagaacctatctcccagcaccacctgcaggggatgaggaagtctgcaacaggattcaacacttccttttctgccaacatatctttagcccaacattccattattgagaatctaccaagttaagagcctgcttttagtggctgaggagaatacaaagaccaataaggataatctacccatactctgaggaacattattaaaacttggggatgtttgtgataattaaaatagcttggaaagaactgattaaatcgaagagaatcagacttcttttgtgaagattgaatagtaaagcaactactgcattgccattttacatcccccactgatagaaactaataacaaaggtgattccacagttttaaaagtaaaataataatgattagttttggatcttcaagtctgttaagtttgcaatatgatgggaaaagcctgtgttgcacaccatcttatatggacctgttaagcatgctcttttcctaatttaaggctggccccagacagctaccttagggctctctgctagtcattagaggaatcagatggaaaaagatacatggattagtataaatccatatgcacctattcagtaagtaataagaactttttccagtaagagctttttctttacttatcaaatcatgtcctagaatttaaagagaatgaggttttcaaaagttcctagtcttttgaaatctcacaaacaaggataaaatatttgttttttgatttcagaatttaacaaagaagcagaatataccagacacacaagaagcaaaagaaatgaaatgagcattcataacaacacgcttagagcacagaaagccttatcctgggtgagtgatcaggaatatgaataaagctgatctgtaggatggctttcaatgtttttgtttagatgtgcagtcttactatatgtacaggcaagattactagagggaacagtcagtcagctatcacccatcctacaacccaagaaaatgctcacaggcacctgggtagtcatattcaggtgttctcagtcttttttcactagagttttgaactgcctattgtatattaaggcttgagttaccactcccaatttataccactttccaaaatcacaccacacattataaaaacaatgatatggattggtaattacaataatacaccgtcagaggtaaagggatacaatatgtcatgtagaccagttatttctcaacgtatgggttctatatctgcaaaataatgtattgcttattacaaattcagactactaggctccatgtcaaaacgaatcaatttcaagccaaggatggaatccaagaatctgcatttttgacaagctccttaagatgatatgtgcattaaggtttgggaaccattcatatagtcaaactccttcatatgacagataaggacatcatatgagagaagttaagtgatttggccaaagtggacagccagtcagaggcagaaaccagactcacacttaaatcttgactcctaagctacaatttttccagttataaatagtttgtatttatttgtaaattcccggtacacctaaatgaaaacggaatttgaggtctttgttccttgacattccccaaaggtttaataccaataatttactattaatgggctcccagcacttgctaagtaagctgttgtcttccgatttagggaatatcaactatagaagcttgtggacaaaggtgttttgttaacttgttaccatcccattccccttcacaataagacatgcaagttcatttatcaacaagagcatatactcatttttctcaaatcacaagagacaataaaaagtaaatggaaaaccctgctactagtgttaaacaagaatatcccagcctctataacaacataccatatggtatttccctaccttgttcagtatttaacctaacaatttattgctaggcttcttggcagcaagctgtgcaagttgaagtggaatctgattgaggtgagttaattaatgtggtggcagctcggaatgttgtccagctgccagtgagaattatgtttgtttgcctttggcccaagtgtgaaatggctggctgttgatttcagaagtgtgagtgtacatttttatatctcacatgaatgaatacattttttgtatcctacacatttggggaaatgctaaaatttattgggtcatgttatttaccacttgtgtggcagaaagagaaaggtggaattttgccccagaggttgactttgcatctgtagaaaaagcaaaagcaggtggcatataaatccatgagcaggtaaataagctgtctgaaattagctcatctggcctaatgttttaaagaataacttttaaaaggaggtaggcaagatttttgaaccagaaaagaataactcttgtaatgatgaaaggattttgaaagtaggaaacatagtttttagatttccctggaaagacatggcttttggatttactgttgacttacatttacaattcttatttttactacacacaaccttctattgaatacatcatctcactgtgcaatcttcctttctatctataactgatgacagtgatttctgtgatgtgttcttaatgttcttgataattttgactagctgttactgatatgagcagggggttctccaattcaagcagtcaataactgacactaaactaacaaagttcaaagaacatttgaagtgtgtcagatattattcccctatttttttctatgtaatatcctgttaagttaaaatgccttgagaaaagtttaccttagattaaggaaatagatacttaaaaatataatgtataaatatttcttttattttaccattttgaacaaaattaatacactaaaagcaaaggaaatagcatggaagtgatgtaagagcaaataatatgaaaagtttgcaaatctaacaaagcattaccaaaaccctttttgatgacaagcagatttccttaaattttgatgttaccatgaggatattaagaaaactttaaaataaaagtgttcatactttggaagacattcaatgaaattagtctggtaaaaaatctagtaaaaatagtattttagatgcagaagtatatagaaaaaacacaagtgaattagtgcagatataggaccatggattcacagaactttagagaataaagagaaagtaaggaaatttgaataaagtatgaatttagttagtaataatggattgatatttgctcattgatcattacaaatgtaccatactcatgtatgatgttaataataggagaactagacagattcctaggctaagtttctgtgctggtaaaattcatatacatatgaagtactgaatgaatggtatcattcttaaggtattataacttgtgttgatgtcagtaatcatctagtacatgacaacttctagagattcataggattgtgatatttgttatgctaaggcctcctgaacaaaaatggcactttatttagaaggtgcatcagtgtattagttatttgtgttaagaattacctcaaggacaggtgcggtggctcatgcctgtaatcccagcactttgggaggccaaggcagatggattacctgagctcaggagttcgagaccaaaaaaaaaaaaaaaaaaaaaaaaagggggggaattacctcaaaatctggtagattaaagcactaaatattatctcataatttctgctgtggttcaggaatttaagagcagcttacctagggggttctggctcagggtctctcatgaggttgcagtcaagatgtcatcctgaactagagttattttatttttttacacaatgaattacttttatttcggtatgcatccacatttcagcatttaatggtcctgaacagaaagtggaaagacgcaccaatttcccaggaggtcaagcccgccaatttcagggatctgctatgcacactgggttctttcttaatccctgctgaggatcttgagaagcagcagcagcaccaaaaccaaggcacgcactggattcaaggttctttttgttccagttgtcagattccaaactagacctcaatggattgcaaggatgaccaaatgaaagccctgtttaaaacttcttcagtttttaaaagcaaaagcaattacaggaagtaaaacaattcagagggatcacgtgtgcttacaagtgtcttcttgtggtctttctccaatttcaaccaccaaggactccgagagctggcaggtctgagtaaccctggtgactttccttttcaccttatcaaaacctgagctaaaaacaacgcatcagctgacgacagcagagggtggcagggctgaaaacccaatattcatttcccaggctgatggagaatgaataagtatggttccaaaactaaacaagggaggttagagactttctaaccttacctgatggcttctgcccaaagcaaggaagtgtcatggaaggtattgagtggtgatggtgcagaaagcaacttgaggagggaagaaaaaacagcatccctcgataaaggtgggggagagaagatactgggaaagccctgaattccttaccaaaggccaatcttagaggggagcggaggggttacaacctatgcttctgccaaaggcaggagtggaggagtgtggggacaggatgacggattggaaggtgcataagacttaaagaaaccaggggtgcaggtgaagcaccccacacacctagcagtagtcccacaggctgcaacctgaaaccttcacatccactctaacaagccaagctagagggctgttgcagggagggtgggaggcaggagggtaaggggagaaggcagagacccccaggccatgtaatcagcaaggtgattgtgtgatgtttcttttcacagttgagttagatatgccccactagttatgatgggaatcaatttaattagaatttctcgattccagaagttcaactacgtggacagtggttacacttgataggatgatttgttatagcaaaacttatatatttc

SEQ ID NO: 5888 - DNA, 1234 bp, Homo sapiens
agttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggctgggcccggtggctcatgcctataatcctagcactttgggaggtcaaggagggaggatcacttgggcccaggagttcaaggccagcctgggcaacatagcgggacgctgtctgtacaaaaaataatttttttaaataaacgatattatgagga

SEQ ID NO: 5889 - DNA, 763 bp, Homo sapiens
aagagctcctggatggctgtgctattgccaatgaaggtgactgccatcttgaggccacgaggtgggatgtcacagacggctgtcttgacattgttggggatccattccacaaagtagctgctgttcttgttctgcacgttaagcatctgctcatcgacctccttcatggacatccgaccacggaagacagcagccacggtgaggtatcggccgtggcgggggtcacaggcagccatcatgttcttggcatcgaagacctgctgggtgagttccggcactgtgagagctcgatactgctggcttccacggctggtgagaggggcaaagccaggcataaagaaatggagacgtgggaaggggaccatgttgactgccaacttgcggaggtcagcattgagctggccagggaaacggaggcaggtggtgacaccactcatggtggctgagacaaggtggttcagatccccgtaggttggtgtggtcagcttcagagtgcggaagcagatatcatagagggcctcgttgtcaatgcaataggtctcatcagtattctctaccaactgatggacggagagggtggcattgtagggctcgaccacggtgtcagacactttgggtgaaggcaccacactgaaggtattcatgatgcgatcagggtattcttctcggatcttgctgataaggagagtgcccattccagagcctgtgcccccgcccagtgagtgggtcagctggaagccctgcaggcagtcacagctctctg

SEQ ID NO: 5890 - DNA, 841 bp, Homo sapiens
gcagactcatcaggggcagatggaaaaataccaggattgagcctctcagaagtgatgcttgaatccagtcttcaaagatgaggactccggcaggtgacgtggcaatagcgttttggagggaccagtccagatacacaggcatggagccatgcatttgttccagaaagtgtatttggatggaaccggaacatggaacaggacacacagcaggatgcggagcagtgtcagatgaggcatcactggttccacaaaaggtaggggaaggtcttgagggaccaccccatgccctcattaatcaaccagaagcttggcccggagcagcagcggggattccagtagctgtgggcatacaggatgctagggcggccacaacccaggcagctgaggccgagccacctaggaacgcaggctcagagcagaccctcttgggacagacggagaaggggagggggcgggcttctctaagttaagccgatcactgagcacctcactggacacgagagaaggcaagcccctcggaggacagaagggaagagccacagacttggaggctgtgaaagtggagacaggtggacctggggtggcagcaatgcgtgaaatgccaggccgtgcccccgccccaggagcccaacatgacaccagcccccagggaagctgactgtgccacttcatccagcgcccatcagtcgccttggagcatcaggaatcctgagggctggggtcccggaggatcacagatgctggggcacctcaacctcagggagccgctcgagaagtttcttttctgaagtgtccacctccttctggtcaccggctggagctgggacaggtacatcgtctg

SEQ ID NO: 5891 - DNA, 7810 bp, Homo sapiens
cgtcagcggcctccagggttgctccagccgcgaatcccgctgccctttgccccgcgggcctcccaaggcagccccctgttagcccgaccggcttcgaagcccgcgccggttgcggatcctccgccgcgcccacctgtcagcgcctcggccggccggggctcccgccgcatgcaagcagcgaggcgaggtcgcgctgaggcctggccatgccacggacggccgggcctcaccctgccgctctctcgccgtccagaggcccctgctccacacctgggtaccctgggtcctgactcaggtgggctgggtcatccccgtccatcagggaagggcagctgggtgagaagctaacggcttgaaggaacagggctacaaggggagtttgtgctgggcctggcgtcccaggctgtggactggaactggacatgagaaccccccctacaccctcccaagtcaaagacactccaaaaagacagtttctccactttattagcctggagctcctccctgccagccccaggggctggtcgctggtccctgggcacagtgagcagggctgaggtcagacgggttcggcccttggccatggcagcttggttgggacagccgggccaagggaaaaaaaggtgcaaaagtccaaatgctggcacttcaggtgtggccggcacccagccaggcgcagtgggtgggcagggcgccatgcttctctcctggcgacaggtcggccgtgtagcagcgccccctcccagcagccactaggaacagctggtgattctcgccaggaactgctgcgcccaccactcgtctaggtcaatgggcacaaagtctgtgggcagagaaggctgggcagtgatgctgcctcccaggccagccggcaagtctcccctggagctaaccacaagccgctcacccggactccgagtgcggcaggcgctgggaagaaggggtttctgcacaagagtcccctccctcatcccctggggtgggaacctggcagggcctgggtcaggatcagaggggctggggggtctctcctggggggacagggttggggggctcactctgcagccggggattgggggtcctctccacgtactgcacaggccttggcccgccctcaccggctgggccaccatccagctgctgttgcacctgctgccaggctgtgggaggagggcagtcgggctgagccaggtcccaggcaccccatcgcccacccagggcctgatggtcaccctggactccagccccacacagggctggtcacaggacacaagggcagagtgccaaggaaaagcacagccatgcagcggctgtgggtcagcttgaagtggggccatcccgggtccatggttttgcgacccagcagcctatgccgcaccctctggccccgctcgctaccttcggacacaaagcggacattctcctcgtgggccactgtgtaggtctcctgggtcccctcgaaggatggggacgtggagggggcccgccggccattcacacgattgaacacaagccttggccctggactgcaggaagggaggagacggacatggttggtgcccatcccaggtgcggtgctgcctggcagaactcaggagcagccccgggccagcccactttccccagacttggccagcctaggcacttcctgaaccagagagagcagccacccacagcagccggtggcccaggcctctcttgcagtccccaagccatcggcagctcagctcacacctgcagccctgtgtcctgagggaagtgagtgactgtagggtgggggcctcagtcttagagtgtcccaaacctttggtcgggccccactcagtacccctccccgagggtcttgcaggtgcccatgctgccacctgcatcccatcagcagcccagattctgacctgagccacgacccagtccatgaccatgtctctctgccccaacccccccactctgggtgtagttctaggccacattctcgccccacagaagcacctccatctccacgatgtttccctccatggacggatggacctggacgggaacgggggcctttgccctctccctggctgcccccacgtcccatgggatgaggactgggtgccgggatgggcagtccctgagtcgggagagtgactataaccctcgcccactccccaccggcccgagacaaggggcgatgccaaaggagatggctcccgcagtgccgcacgcaacgtctggtgggcccctgggcccgtcccggccagccgggcccagggcagggatgagcggccccagctggccgagccctgagcacacaaagcccgggacagggccgtggagggaatggggccgcacctacagccggaggtgggagccgggagtcctgggctgcgcctgctccgccaggcactcgcggtcccggccggcctgttgccttcctgggctcaggtgccccagcgccgctctcggttcctcctcagctgagaggggcactaaaataaagaggagtgtcttgaggggcgcagggtcctgccggccccagggctggcagggtctggtggccacagaggatcttaaaacgtgcaggtggagatgggacaggggcaggggcacctcccaggcctgcccgctgcctgagtttctgcacaaaccacagggaataaagtttgtccacttggaaagcccccttgcctgcaacccactcccacctcggaaagccagaaactccaagaaagcttggaggttggattatcaatgtctaagaagacaagaacattgccaggggctgtgaatcgaagggcggaggtggcggctctcgggcagagatgggccccaggaggcaggcaccgccccaggggctctggttacgtaaggctgctgctctctgggggaaagggcaccggcccggcgagcacctatggatcaccgccaacctctcccacttccagggacactgctccgggcaaacttcagcccagggaggtgaaggctgtggagtgcatcctctcctctcccctccacagcccatccctttttcagcccatgaagctgggcttgggagagaatccacctgagcatattacatgctgggtgggggcagcaccaggatatcatagcaaatccaacaacagagtccatggccctgacccagtacagcccccaagccagcccctcagcctgccctcactgggcctccccacccccgtctcttgcaggctgccccttctcgccctgtggggttcattccattgtcccttcctgtggcggtccccacaccctccatctgccctggggtcgggtgatcacatggccccgtttcatcttattacttatatcgcctcagtttatcttactgcctcccctatccatctcccaccaggaggaagaacttgtcaaaggtgtatctgggctgggcgtggtggctcatgcctgtaatcccagcactttgggaggccgaggcgggtgggtcgcctgaggtcaggagttcaagatcagcctagcatacgtggtgaaactctgtctctactaaaaatactaaaaattagccgggcatggtggcgggcacctgtaataccagctactccggaggctggggtgggagactcacttgaacctgggaggcggaggttgcagtgagccaagatcacgccactgtactccagcctggcaacagagcaagactctgtctcaaaaacaaacaaaggtggccgggcgcggtgactcacacctgtaatcccagcactttgggaggccgaggtgggtggatcacgaggtcaggagatcgagaccatcctggctaacacggtgaaaccccgtctctactataaacacaaaaaaattagccgggtgtggtggagggcgcctgtagtcccagctgctcgggaggctgaggcaggagaatggcctgaacccggaaggtgaagcttgtagtgagctgagatcacaccactgcactccagcctgggctacagagcgagactccatctcagaataaaaataaaaattaaaaaaacaaaccaaggtttatctggtctgtcactgtcgtgggcagtgcccagacccatgcctggcaggaaccagagccagcatacatcatgggtgacaagccttgaccctctgggtgcaccaggagatgtgcagggaccccgacacccccctcccgcgcccagtcagtgagagatgaggagtagcaaaaagcaccaaggagaagaaaaggcagggcagggccgggcgcggtggcccacacctataaccccaacgcttccacaggccaaggcgggagaattgctcgagcccaggaattgaatactaccctgggccacatagtgagacctgtctacataaaagttaaaaatgagccaggtgtggtgctcgcctgtcatcccagctactcaggaagtcgagaggtgggaggatcacttgaacctgggaggttgaggctgcagtgagccatgattgcaccactgcaccccggcctgggtgacagagcaagaccttgtctcaaaaagaaaaaaattaaatgaagtaaaaaacagcgaggtgggtggcagcatggggtggggtggttcagagggaaggtggttggccaagcacggtggttcacgcctgtaatcccagcactctgggaggccgaggtgggcgcatcaccggaggtagggagtttgagaccagcctgaccaacatggagaaaccctgactctactaaaaatacaagattagctgggtgtggcagtgcacgcctgtaatcccagctattcgggaggctgaggcaggaggatcgcttgaacccaggaggcagaggttgcggtgagcggagatcctgccattgcactccagcctgggcaacagagcaaaactccatttcaaaaaaaaagaaacagagggaaggtggttgccccaagaaggtgcaggagcaggatgggggcttcatgcagagatcccactgctgccagaagctcccagcgctggggcctgggggtgggaaggtgggtgaccccagggaggagagggcagcacacatcctgccctgcccagggctcctctagccccactgcacacggggtgaagcccactcaactcccacaggtcccactggctgacagaggacctcacatggggactttaagaaaacaggccgggcgcggtagctcacacttgtaatcccagcactttggggggctgaggcgggtggatcatgaggtcaggagatcgagcccatcctggccaacatggtgaaatacaaaaatataaaattagccgggcatggtggcacgcacctgtagtcccagctactgaagagactgaggcaggagaatcgcttgaacccgggaggcagaggttgcagtgagctgagattgcgccactgcactccagcctgggcgacagatggagactctgtctccaaaaaaaaaaaaaaaaaaaaagagacaacagccagtgggcctggtgttgcccactgggacccttggggtcccatggagaactctgggaagcatttccatcttcttccctaactcctcctaactgtgccacagccttacccctgccctccctagcagtggggtcttggagagagaagaaaggtggtttccccaggttaagagagacggcgtcaccctgggccactccagcctcatgctccctgcctggggaccaggtggtggctacaggtgtgcctcggtttcctcccctgggaagtagagcggccacgaggaccaagggtgatgtccgcggagcgtcccagcagagctgggatgctggaagcacctaggggcccactcacctcccgccagaaggcgcctctggtagagggcacttacctcactaggatggagccccagagagcccccgccccgctggaacctccacacctttctgagaggtaggcagggggcaggctgagggtggctcggcacccccccacctgtagctgccctgaactcctggcccgagctctcctccccagcaccgcctcaggccatgaccctaccacctccaggagccttcgggccggcttggggccacagcaaaatccacaggcctgggagaggcacaggataaatgaagggaacggtggaggaactgagccaaagtcaaacgtccagccctgcggggctgtccaacctctgggtcatggtcacggggaggccacagtggccggactgaggctcctgtggtctcggagtttcctaactgggttaggaaaagcagaagcaaccggatggggggaggccccactgccccagggtgtctggggtgaagggcggaggagggcagcggccctgcccgagggaagcgcacgcacgtctcccccactgagctctgcaagggcagagccgggagatcttgaggaccagcgcccgacgctctccgcgaaccgtggcctgggcctgctgcacgtcagggttccagcagcaacccaaggtcgcccgaagcaccgacctcggacgctggaggcccctgcgacccaggaactggccggctttctccccgctgggggcccgggcccggccaggtgaggcggaagtgcgaggcgcaggcccgcgggcgcgtagtgggcaggacccgcgcaccccccgcgcccggagcgcccgccccgcctgcagcacgtggccggacctcactaacatttccccaaggtcaccctccgctctagggcggccggcgggggaggggaagccgggccgggccgggccggggccgcgcgcgtctcacctcgacaggggccagggtcccggcggctgcgcaaagggctgcgcccgcgggggctgcgaggtcggcggcgcgggctgccggcatttcaggagctcgccgagccggccctccacctgctgctgcgtgggacctgcgggcaccggggggcggtcagccgccgccgcgccccgccccgtccccgttcccgttccccggcccgtgcgcacctgtgcggcgctgcgcgaccagcttgctgggccccttggtgatggtgtacatgacgcgccgctcccacaccgccgccggcccccggccagatccggcccctgcgccggggctcgcacttaacggactgcgggcgccgcggggagggggcgggcccgctacacgcccccggcccttaaagggcccgcacgggctcgggctgaccccggacacgcggcggaggcggcgcttgcgccctttgggaaactggcaggcgggggcggagccgccagcaaccccgccccagcccccggaggcccgaggccaaggcggacgaggcgccctgctgcccgggaaggccgttgctgcctggaggccatgtcagtgtcggggcaccgcactcagactgctggcggcgaggacccaggggccctgcggggtcagcggcgatgtgcgagcagggtcctcggagccccagggcccacctttgacaagcgctggaggagaacctgtgctgggggtccctgtgctgggggcatccctgtgctggaggtctctgtgctggcgggatccctgtactgtgggggggtccctgtgcctgtgctggggggctctgtgctgcgggccctgtgccgggggcatccctgtgctggggggatccctgtgctggggggccctgtgctgggggcatccctgtgctggaggtctctctgctggggggatccctgtactgggggggggtccctgtgcctgtgctggggggctctgtgctgcgggccctgtgctgggggcatccctgtgctggggggatccctgtattggggggccctgtgctggggggatccctgtgctggaggtctctgtgcttggggggatccctgtactggggaggagtccctgtgctggatccctgtgctgcgggccctgtgctggg

SEQ ID NO: 5892 - DNA, 1036 bp, Homo sapiens
gttgattatagcaactacatgaggacatatatttaacagtgaaatgaagatactttatttcaggggaaaaatgacttttaagaggctctaattttttttcttggctttgcacagacaaaatcaccacattttgctcaaccctaattttgtcatttataaaatgaaacgtttagcctaaataatctctcaggtctctttccaactcgtaccatgaatctgagagacctggaaaggaagtgggacaacatttctgttgtgaagaaggcaaggctggtgatgtgggcgtgaaggttaaagatgctggcccctcatgacattggcgaacgtggcccttcttccacctgctcagccagaaacgctactgagtgcagacgtttgtatactaagaggtatttgggtgcatacgatttaatccttagcctgatgagcttataagtgtgaagagaagcaagactgttcacaaattgctaaaacaaaatatgatgctacatttacccaacaaacctaagattctgtgtacaaaacattgcagtagtatcactggaattgtgtgtgggctgctgtgagttcagcgtcctctcagagcaccgtggttccaagtggacggaccttaaagggttccataatcaggacaggttgaaagaatagtgaatgccacacaaatgcccccacacccttgaccctgtgccaccaaaggcaaaaccaaaagacatttcaattgggaaaatcgtgatgcttgtctcttattttctttcttttattattattaagacacgattatcattcaggattcatgctgtttacagtttgactacttcatagaaaaatgtgtctataaaacacctggtagttgtaaaaaggcttgggtagggcccagaaagccagatacatgcatgctatttattcagctgccgggagccattccctgtctccatacacccaaggattgtctatcctctcctaaattttatttctaatattcttgctacatagtcaggttaaaaaaatgaaacacaaaaaaatcaggaaaatcaaa

SEQ ID NO: 5893 - DNA, 1954 bp, Homo sapiens
gccaacctgacaaaggctgcagaaaatgaagttccttcataggaacgaaaacattagaaactgagccctgaaattcaggagccagtcaaacctcttgagtttttattgaagaatccaagtttacatcaataaatacctcagatgaaaataatgatcagaactttgagttacgggataacataaacattccctccaatttattgcaaatctactgagactttggaagtgatcaagtaactgggaaagattttatggatattgctagtggagtgaaagaaaatgaattagaagctcttatatcaattttaggcaatcttctttcacttgtttctactcctcaacctgtagagaactccttgttagtacacaaattgggaagataaaattaatttattaaatagtgagaaatgttctttgatggagcaaattagaagacctaaaatggccatcctcaaaaatgaacactttgccatttggtagtttgtgattccattcaaccttctttggaatccctacaagactctgaagaaaatgaacagatttcagtcataaacagttcaggcaaggaaagaaaaaaaaaaaaggatattcatctttcaaaaccagataatgttgattccgagaattccccagtcccttcccttaggagagaaaggaaagaatgctgttttctccatcaagtaaaagcacagttcactttgataaaccccacaggaaactgtcttctgctttccactatgcactactttctttttgtcaagtgtcaggagatgctgcttaggatcagaagtgtctctgactgcagtgaaaaacaccttctgctgatgcttggatattgcttgctatacattgcacttgacgtgctgctggcaaagacagagacactgatgccctcagattgtatacaacgtgcctacatcttgaatctaaaaagaaaaatcagcttctccacattctttctagtatgatcaagaggccagataaagagccaaggcaagtgatactaactggtgttacggcattcacacatcatgtcggaccaacacatgcagaagccgaacatttaccacagtgatgggaagaggtgagtcacaaagacccaaaaaggacactacttgtagctaaatcctgtggagtagtggtgccttactttcctcaagaagttcctaactccctggtcctccttaaatggaaggtaaagcatatttgatatgagaagctgtgatcaaaagccttggtatcattatgggataccctgatgaaccaggcaagtatcagcaggtttttgaattgttgcctttggccttgagtgatatctcagaaaaagtagtgagtgcaaaacatctagtacttttaatggcctatgatacttggaatatggaatttggaaatgtacaatcttacacctacattgctgaataagactgaaaaacttatcagggaaagagaacaaagggaaggagggctggatgaacataagcttcacatgtatctttctgccttgcaatccttgactgtgtcactctttgcattaatggtacagaatgtacctttctcaagcaaagacaagctccatggtgaagtaccacaggtggaagtgactgggttccctcagcctatgtcacctcttcaagatgtgtttattactggaagtcagaagcaattggtagtgctacttcagttttataattaccatctagaacatgagggtacaacgtgagagtttactgtgggttgtcaatcattaccacaatttacagaaatagatggcaaaattaatgttacttcacctgcttatgtccatgaattctccagattgttctagtgcctttgctgaacatttggcaacatgttttcaaacactaaggtaaaacttgagttccaggagattttaaaactgtctgaagaaaacaattccttaacaggaaatagagtcctcaccaaagcagctata

SEQ ID NO: 5894 - DNA, 2621 bp, Homo sapiens
ataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagccatccagctctgtcactgatgaaggtctgaactgccatactctgcccctttggtgtcagccttaaaggtcagttttaggtgagtttcaaccagtggctgtagatgggtcctttgtttaccagtttccccacatcctgtctgagaccattgctagtttttgtctgcaccagtcttagggaaaacaacctggacaccgtgggtgagatcaccagtgggctccaagccagagcatgggcctgggacagggtgggttaccttggcatactctaacatactcaaacctcatttcttttggggtgatcagacccaacagcaggtcatgggggcgacgaagtccagtggagtccaaggaatgagaaagacagtttgagagacaaaatgggaccagggggctatcacaagtgtggaggctgcaacaaacaggtggtgaggatgtgggggttgaaaggaaacggtgtatcaagtgaatgagaaacatatggctacttgagaacatgggaatgctagaagcaaggagcagcaagtctagcaaacatgcaagccctgcctcagcttctctcccaacactcagcttttcttccaacacatttcatgtgcaaggttctcgtgcccactcctcttgtacagtttggcagcctcatggagcttccctggtaggaaaacacatctgccagaaacaggtcattgttggtctctccccgcttcttcctctcctggaaaaattagaagcaaaggaaatggcctctgcagccatgggcagaaagcagcctttacaaaggttagatgtggctatttcaagtgaggcccctgggccttcctactggaacctgggcttggctcctggctgttgtctctctcccctaggttcccgctgggaaggcttgataacaaaagcaggcttttaccagacaagcaaagatcaaaaaaagatgcaaacctttgtttgtttaatggaaattcctcagggttgctttcctgtgtattccaaagctatgacggaatagtttgaatagtgtgtgctctgactcatccatgacccctaagctcccaagatctcccaaatccgcaggccccgtttggcagagttgtggctcatggggatgacagagcagaatgtttagggtttctgcccaagagggagaccaataaaataggatgacaagtcttacgatgtccctacttctaaagagaaggtaagaaatcccgtgctgaacatccactaggttctgggtatatactttatacacacatggcccctttattcctctcagtgaccctcagggtaggtctcactacccaagtgttagagtgaaggacgctgagaccaagaagaggaacaggtcagggtcagacagagctggaatttggacacagttctgtctgactccagatattccttgtatcacacaatactgtcttctgaagcaagtgattgtccccaacacacacacacacacacacacactctctctctctctctctctctctctctctctctctctctctctcagcagagctgaggataaagaggaatatcctgcacacttcttccttctgtgtcagggaacatttgcttgtctacagctcgagtatttgtaaacactcagtagcacccaaaccctgagccctagcagtttccttttgcttgtttactagcaagagtagcatgtcggaggacgatgagacattgaatcaaactcttagacaagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgcaaaaaaa

SEQ ID NO: 5895 - DNA, 15053 bp, Homo sapiens
gaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcgtttagtgcatctttgcccacatacaccacaacatatcaagatgcatttattaggaaggaggagtttagagagcaggctatcagaataaccactcatcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatggtaaatccctctgtttataatgcactttacagtttcaaagcacttgtacgtacatttatctcaattatcaaaataacagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattgggaacctcaggaaattttccagcttcctgatctggtgcccctagtcacataggatgtgtgatcacgtgatagctacatctggaccagaatcccatggcaatatcccacggtttaagggcataatatctccgtggtggtagattgtcaagtcaaaaacgggacatgttctaacagcaaagctacccaatatgaaacacaaagctacttttagattttttaagacttactgatattcctgggccctaagagcttgtctatggtcctatctttgcaaactagtatttacacaaaatgagccacctggtttttttaaagtcagtattgtgtgtgtgtgtgtaaatatgacatggagaaagcttctgttacctagtaagatagtaaagtatgtaagacatggcccttcccccagtctacattgaggtatagtgtattaaaggatctcaggagacttgcagcaaattactactgcttctgtgcttaaattcagaagtctgaaaaaaaaaaaaaaagacttctagtaaagagttccattttgctgtttaaccctttgtgtcctaagtttaatcaaacacagaaggatatttttttgcatcattccatctaatggaatgcagaaactgctctagagcagtataaccagtgcttcctgattgccagcagattgccctggacaccccagaataaacagcatcttcaaaatccccctttctcataccttcttattaatggttgaattagtatgtctctgtcatctgagagtcttgcatcttgaccattacctttattttctgtcaagggaatccctagaagatgtatggggagacataggaaaggaatggaagaaagttaattcaccccaaattggataaattccatgacatttagcaatatacttctgtatccctagaattgtatcataactttagttcaaggacattgcatctcaggtgggttaaggaggttgggaaggggagaaaagggatgaggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgatttaaaatgcctacttttatgttagtaaatattaaatataaatcattcattactcaagttgacagattgctataccattgcttgtttgagaaactcagagcttagtaattgttccttagttttttaagcatgtctccttcaagtgagtttatttggattatcagaattttgtggttttaaggtttatcaaagattattctagttcttgactgatgttgatctgctaagactattgcagtatccacattaggcagaaagcagggggaaagtcactttttttaaaaaatccttgaaatattctgatgtcactgcaattaaggtcaatagtgaccttttcattgctaaatccgttacacctgcatctaatatgaactttcagcagcacaggtaactcccaccagcttcttgaaacacttcccttaagtgctataatacttttaattttcttttcaacttgcagactactcctttattgtaggttcttctccccatcatgtaaatataggtatagtggacatccattgctttggcttgccaaaaatcacttcccctttactttaatcatacatccccacttatcctttagaaagctgctccttcccattctgtgtggtggtagtggaaatgtagatgacagtactccggcctcatgccccctggctgaggtttgagcaatgcaagctcgttctgtcccacaaggactttgattcttaagaaaggtgaccacaaagtgatcagagttgagtcattctgatcgtagtgttctaaagaaaccatttaaaagtttatgaaaggagatctccaaagtatgctggctcctattctccaagcctggttgtccaagttttcctttgattgtataaactaccacatagcctccttaaaataagtttcctttttgtcagccaaaatgggtttctattgctggtgaccaaatgactgactaattacagaaatggaggccggagagttaaatggtaggcctttaacccacaggaacatatggaggatctggaattgattattgtactgagacagataatggcaccagctcttgttctgtgtccctgggaggataaatctacgagttaagggtgacaaaacagtaatgatatcatttcttgtcatttggaatcgtgcctgttgagagtagaatttggagggccaggtaattgttgacaataggacaatttaaagtggatagactgggcacagtggctcacacctgtaatcccagcactttgggagaccaaggtgggtggagcaccttaggtcaaggaattcaagaccagcctggccacatgatgaaaccccgtctctacaaaaatacaaaaattagccaggcatgatggttaatcatgtaatcccagctactcgggaggctgaggctggagaatgacttgaacccaggaggcagaggttgtggtgagccaagatcgcactgttgcactctagcctgggcaacagagcaagactccatctcaaaaaaaaagaaagaaaaaattagctgagcatggtgttgggtacctgtaatcccagctacttgggaggctgaggcaggagaatctcttgaacctgggaagcagtgtttgcagtgagctgagattgtgccactgcactccagcctaggtgacagagtgagattctgtctcaaaaaaataaagtggataaagcaggccaggaccactgagttagaatggttactttgattgcattagctattttattttttttaattttatttatatatatatatatactttgagacagagtctcgctgcaacgcccaggctggagtgcaatggtgcgatctcagctcactgcaacctctgcctcctgggttcaagtggttctcctgcctcagcctcccaagtagctgggattacaggcacacgcgatcatgctgaactcatttttgtatttttagtagagatgttggccagggtggttttgaactcctgacctcaagtgatccgcccacctcagcctcccaaagtgccgggattacaggcatgagctaccgcccctggccccggtagctgtcttaaagtgaagggcatcagctcaaacccagaaactgacctgtgggcatagaataaaatacaggccctttttgtggccaggataaatgaatctcggtgcttaaatccacactagtacttggagattaattattcaaattgcaaaattacaatgctggttgaatttgtagcattactaacgtctcttttgtgagagttaaggtattaatcagaaaagagactgtatagagtgctgatacctgggaagattcagaagatttagagaatcccaatcctcgaaatatctcaggaatgaaggtttgggttaccctattagtcaaaaatccctgactgaattaaacaaaaaagtatagtcaaagaggaagagataaatagcagttatagccccataacctgttggagaagtaagatctgtagcctctaccccatatcttttaggttgccttattttatttccccctctcctctttattcattacagtattctgccctaacatttcctggctgaagtttgagcatgatgcaagttaatccaatcagatttctcctccattggagctgagccattctagtggtagtgtcccctcactgatgtgtatgagtgtgttggtgatggttaaatatatcaggaaatccgtaagttgcagattatcaagatggggttaagaactagagaagaatgagcatcacccagaaatcttaggcttataactagaaattattttaggttatctccctttaagaggaagatctccctttaggggggattatgttgagtgaaggtattaagattgttcatgttgaagaatgcatgtccacatagtgtacgtttgcctacccagtgttatctttttcccctctgagaatagcacttcacctttcctttgggaaactacccatttcccatgccatgtgagcccagaggataatgtgtaagaggtatatgagtttctgagaggaatgtgagaggtcttcacctgcccagattcctgacttaatctttaagtcttcttgccctgtagactctgaaaaatctcatccatttccatggccttggtttctaactgtatattgataatttccagattcctacctttggccttgatatgtgtcttgagctccagatctgaatgcccacctgtaccttgatatccactgcttgattaacacaaagatactctcacccaacataataaacgctgacctcttcattttttccttaaaatctgctctccagtgttccctttgttggtaaatggcaccaccctctactctgtttctcaaaccagaacatgagagttattctcgaagcttccctctctcccagagtccctgttagtcattaaatgatcttggtgttagcatgtaaatatataccttaaaactatctccacttctatcactttgtccaagggaacatatatctgttgctgtaagtactataatgcctttctagtggtttcactgcctctattattgtcccactgcagtcttctctacaggacagctagagtagccccccaagagatagggtatccctgttgcccaggctggaatgcagtgtcaatcatagtttactgcagcctcaaactcttggcctcaagcatccctcctgcctcagcctcatgagtagctgggactgcaggcacgtaccaccatgcctggctggccatttatttatttatttattttgtagatacactatctcgctatgttgcccaggctggtcttgaactcctggcttcaagcaatcctcccactttggcctcccaaaccactaggattacaggtgtgagccactatgcccagcctacttaaccttttaatagttcccccggcatttcagaataaaatctaaactctcctggtttacaaggctcttcagcttctcattatcttattcctcaagcttcatcttttgccacttcaaacaggaacaactcaattttgtatattggaatttcctgtattattattatttcatttgaaaaaaaagtttccacttttttttttttttttttttgaactgaagtcttgctctgttgccagacaggagtgcaatggcactacctcggctcactgcaatctttgcctcccaggttcaagcaattctcctgcctcagcctcccgagtagctgggactacaactgcgtaccaccatgcccagctaattttttgtatcttagtagaaacggggtttcaccatgttgaccagaatggtctcaatctcctgacctcgtgatccatccccctcggcctcccaaagtgctgggattacaggtgtgagccacagtgcctggctgggttccacattttttaaagcagtggagatgcaagaattcattaaaagaaagacaaaattgaaatgattattcagaacaacccaaaagcctattgctatgaatactgtaatttattttcttccatatttctttccatgaaatttttaaaaatctagtatttgtaactgatacagagagctacagtaaggtgcctagagagcaaccaaatccctacctcacaacatttacaaagataaataccaaaaggactacagatttaaatcttaaaatgaaacactagaagaatatttaggagactatttttgtgatcttatgacatgggagattttcataaacaaagcagaaaacctacaagccataaaggaaattacagacatataagactacatgaaacaaatcttggttctgtaaaagatgtgatagattggagagatatttccaacataaatgacagatccaggactaatgttgctaatacagagagttcctacaaatttataagtaaagtaataatcactagccatttatttggtgtttgtttcatacttggcattgtttcaggcactttacaagtgttatttaattgtcacagtttatgagataggcaatattattcctgttttacagctacggaaacaggctcagaaggataaaataacttgcccatgtcacacaataggtgatagagctatgactcaaacacaggttgtctgttagtctgtactttgaaccatgatgctcttcaacatttccgtaagcatatgaaagataatgaggtcagtgagatgtgatgtacaacagagcaatgaagtaccatttgccacctatcagatggcagaatttaaaagagcagtaacatatagtgctggcaagaattagggtaacaaaacttttatacattgttggtgggcatgtagattgttccaatttttttagatgatgatctggcaatactgatgcaaatttttaaatatacacttttggacccagcattcctactttaaagactctcaaagaactaaaagcaccaagataaaaggacatcagtatgagaaatttactgcaacgtaacctgtgctagcaaaaaaatttaaaaagcaatcgatcaaagtggagtggttgaatcagttataggacagctatactgtggagtgttatgcaactgttagaaagaagacctctatttcttagcctgtggcatgtccatgatgcattaagcaaaacaaacaaaaattacagagtaatgtatatcataatagcccattgtatggggtgcagggctggaagccctacaaatgtatctaaatgaacatgaaagaaaagtggaaggatacaccaaattgaggggtttggagaaacttggtgctttatacatactggcattgtttcactggttgtgggagcacatcctttttttttttttt

SEQ ID NO: 5896 - DNA, 1111 bp, Homo sapiens
ccttcgcatttgctgggcaggcgaacccagtcgttctcctcagctccggcctggctcgggcccagctccggggccggcagcagcagcagcagcagcagcagcaagggaagaagcagaagacagcgggacgcgggctcaggcattgaatccatggcccggccgggcccggaccctaaaggaccgggcggttcctcctcccgcggcgcgcgcggagcagtttcccctcgccgcttccgggactgcacacgtgcctccgagcaaccacgacaacagctagcctcccgcccgccctcctctcgcagccgcagcccgccttcaaagcggaccaaggcccgcggacggcgcagccaataggctttctggggtttgctctctagctaatgggaagactatctttttacgcccttggccagtaagagagcagatggtggcctcagcgacctatggcaaagtcctttcccaccccctaacggaggctctgggagagagaggatgcaggaccaagacccgagaagaagcctgcgtctgggcctgggtgggacggattcaggcgcgcagcaacaacagggtgcctggcacaaggagatactcagtaaaactctcatctgctgtgtcattaaggggaacacttaatggctcacgcctgtaatcccagcactttgggaggccgaggcggaaggatcacctgagcccaggagttggagaccagcctgggcaacagattgagaccctgtctcaacaaagaagaagaagaagaaaaaggccaggcgccgtggctaatgtctgtaatcccagcactttgggaggccaagaagggagaactgcttgaggccaggagttcgagaccagcctggtcaacatagcgagacaccccccccatctcaaaaataaataaatcaaaataaaaaataaagaggaggccgggcttggtggctcacgcctataattccagcactttggaaggccgaggtaggtggatcacgaggtcaggagttcaagaccagcctggccaagatgctgaaaccccatctctactaaagatacaaaaagttagccgggcgtggtggcacacgcctgtaatcccagctactcgggaggtggaggcaggaga

SEQ ID NO: 5897 - DNA, 810 bp, Homo sapiens
gaggtgaccaagctcagatgctgagattaaggcggccgggcgaaactcgcgacaccctgcgattccctcttagccagctgcgtaaagttgcctacgccaagcgggtagcgtcctgctcggccacctggcggcgggcgtggagttggcaggcaggcagtgggggtcacgccggcatgaaaggccagatcacctgcaggtcgccaagttgccgggaatcccccgctccgagcagtgtcatgcccatcacaaataaccctatcgcagccgggagaccaagtctagctctgccaccgaggctggagtgcagtggcacgatctcgcctccgcctcccgggttcaagcgattcacctgcctcagcttccggagtagctgggattacaggcctgcgccaccacgcctggctaatttttgtattttttttttttttggtagatacggggtttcaccatgttggccaggctggtcttgaactcctggcctcaagtgattcacccgcctccgcctcccaaagtgctggcatttcaggcgtgagccaccacgcttggtcttgctctagctattctaaacatgaagaagtcatatagcttccttggtgcggtgggctgaagtcactctaagggagtttcccagccccaggggttaaagaactggagtcaagattggaacccagctggcgaaggattccgcaccgctagatcttgacatttgcctcttcttctgccaggaaggctcccctgttcctttttgctgacgtgtcatttctaagtactttctcctactccataaagacttcaagtgagtacacaata

SEQ ID NO: 5898 - DNA, 603 bp, Homo sapiens
aacaaaactaagatggacatttcacacaacgcagagctacgagaacatctcttatgctccttgccatgggattttaatgccccaaggttcataactacagcaaagaaagtaagtcaaaaataaactgagcttaaagaaggtggcaggccaattttcccaaaaagactgtggactgtgggctgctgtgtagcctttgctacaaggctgaggaagcagaagaaagatgaattgggcaattggtgatgaaaagtatttgccattttcaaaggcttctcagtgtggccatagattttgctagtcaatttttaaaaaattatatttttagctcaacacacagctctaaagcagggttcagtgtagtgtgttctctaccgaaatggttatatacagatggtatggaaatggttttaaagattactcataaactatccttttaaagaaaaactagactcggtcatatttgttaaaatgagcaatgtcaccaaacagaaatgtaggtgggaaatactgaaccacaaacatttggagttgcaggcatagactagcagagcatgaatagtcatcactgtttctataatactgaaacactcaaatctgtttctg

SEQ ID NO: 5899 - DNA, 1082 bp, Homo sapiens
cagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaaggagtgtgaagagtgcaaagaccttatagaatctgtgctggaggaggaggtgcagtttcaggagagggagctggccgaattgccgaggtcagctgcaaggctccggatacatgatcccttaattcaggctcaggctgaagaactgacccacttacgacagaagacacaggaagggagaggtgtctgctacctttttacccagcatgtgaagaacacagtcaagtcttttgagggccttctcaggaacactggcattgcctactaccagagacagagattctgtgagcaaatggtacaaggaagccagctgacagagatccttgtcagaaaacttgtcacagaaaatcacaacggtaagaaaaatgaagacaggcaaaagccactggctcctaggtaactctatatgatgaaggggctgataatggactgaccaaatctagagaggattccagaagcaaggactcaagaggttaaaggtcccagatatagaaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaata

SEQ ID NO: 5900 - DNA, 2172 bp, Homo sapiens
tttatttctgtctgttccattccattggtctatgggtctgtttttatatctgtaccatgctgttttggttactgtagcttccttatagtatagtttaactcaggtaatgtgatacctcagctttgttttatttgcttaggattgattttttggttccatatgaattttagaatggattttttctttttttttttttttgagacggagtcttgctgtgtctcccaggctctgagtgcagctgtgcaatctcagctcactgcaacctctgcctcctgagttcaagcaattctcctgcctcagcctcccaaatagctgggattacaggagcccgccaaccatgcccagctaatttatgtaattttagtagagatggggtttcatcatcttagccaggctggtcttgaactcctgacgttgtgatccacccgcctcagcctcccaaagtgctgggattacaggcgtgagccactggacccggcaggatttttctaattctgtgaaaaatgatgtttgtagtttgataggaatagcattgaatctgtggattgctttgggcagtatggccattttaatgatattgattcttctagctcatgagcttggaatgtttttccatttgtttgtgtcatctctgatttctttcagcgtgttttgtagttcttgtccagctcacattttatcttcatactttgagtagcctccttccatgaatggatcatccagtggccgcacttaggttctcctatgaagatttttgttgtattgtacctcagaaccatctccatattctctaaataataataatgatggtcataaattgaatagaagtatttactagatgaggaggaaaaccctaaaacaaaacatgaacataaaatatttttaaaaggaagacatacaaacagacactataaccaaataagatgacagaattaaggccttatgccacagccagagttgaaaaatgcagaaaaaaagtttaaaaacaaggaattaaagccaaacctaacttttatcaaaataaatgtaaaagtgatgaaagaatctgttaagatatcagattgtaatataaaagatactagaaacaaatgccaatagaacacttaagtacattttatatattcatccattagaatatatagctgtcagaatgatagaagaattacatatgtgtgcaaaagtttttgtatccatgtggaaaacacaggaagctaatagtactgtttttctctggagtgggtgtaagggtagagacttaactctttacatccttatggcagccttcgaataccttttaactcccagttcccttaactgggggtgtgtatcctagaatcctcgacccattagaaagtatattgtagacatcatactctttaccctttaacactacacatgcacttcataagaacaagcatgctgtcttacccaagtacagctatcaagttcagaaatttaacattgccataatactttacagtccatatttcaatttcatttgctgttttattggtaatttttttcagctccacgatccagcctaggatcatatgttgtattgccataaccctctaatctggagcagttcctcagcttttctttgttttttataatagtaatatatttgaaaaatacaggacagctaaaggatagagtatccttctatttgggtttttctgatgtttcctcatggttagattggggtagtgcagtgagggttgaaatgctgtaagtgatatgtattgcaggtatacatccagatgcacagaatgtccatttgtcccttattggtgatgctaattttgatcacttgggtaagatgtccagtttctccagtgtatcgttattgtttttccttttgcaattagtgggtaatttgtgaggagaaactttgagaccttgttgacaattctgttcctcatcaaatctacccctcctaggtttagcatcctttgacgattcttgtctgaataaatttttactaggatgtttccaaaattgtgattgttctaactctattattatttctgtattaattagtcatcattctactgtaaggaagaggtttccctttatcatcaacttcgagtaagtacttttttctgagccatttgaatattccttactagatgtggtgcctctttaccccaattacttaagtttgtatttcca

SEQ ID NO: 5901 - DNA, 1781 bp, Homo sapiens
agttaatgttgccatcaacaaacatttaaatgctcaatttacttcactgaatacagacacaacaaatatgaaaatctaaattcatacacatgctacttaatatgaaagtgctttctcttttttaaaaaaatacaccaaatggacactttttacatagatcaaatgtgctcttacaatgcaaaattaaccttcattttcaggttatacattttaaaactgtagctatcaacaccaatctaggaactctaatgctaagagtgctaaaaactatttcatttcttgtaaggaggactctaatacaatatccaatgtaaagaatacatctatatataatcttaacatgttttctgtaaagataaaaaatgttttctttccccttggtgatctttgttcatcctgggtggatcatcttttgaggttttaataatatgaaagtcctattttagaacaatgggaggaaccaaaaggggaattaaaaaattggttaacgtgtgcttgaagcatccaaaaaacaccagtttatcacaacaattggtctttgctaaaattaacaaaattttaataagcaagacgacaaaaagtactaatttaaaaggcttgaaatgcctgccaccattgtcagtatccatccatccaaccttcatttactacaagcacaatactactttgaggatagtttttggaacttattttgacttttttccctataggaaaaacaaagaccaagcttttgaaggagaggactgggaatctagtttaaatgtctacatccaaaattatatcatctttgcgcattcagttgactttttaaaatttaagaatacatatacaaaaagtacttatggaatacatattttaacagcataacatatttgaagaattagttacactttaaaaattaaaacacttgaaaagtattttttaaaccagtaccatggaataactttttgaaacccagattatctggctacttagatgatagtcttcctgttttcaattagtttgaaagattctaatatagattctaacccaacagtttatatggatattttcctgctttaaaaagctgcaacaggctaggcgcagtggctcatgcctataatcccggcactttgggaggctgaggtgggcggatcacttgaggtcaggagttcgagtccagcctggccaacatggtgaaaccccatctctactaaaaatacaaaaaactggccaggcatagtggtgcatgccagtaatcccagctacttgggaggccaaggtgggagaatctattgaacctgggaggtggaggttgcattgagccaagatcacaccgctgcactcaagcctgggtgacagtgagactctgtctcaaaacaaacaaaacaaaaaagctaaaacaatgataaactatttttaatagatattttcattctatatctttatggagaatgtcagtatcaactgatgttaacaagtaaagctttgtcaacaggaattacaatgtgattcacagatcccagaatgacaaggaagggaccttaacccaataaatgattctcccattcaatgtttaccccctagatacttaacaattcaagcatggaactgtttcatgtttacccgttctacatttaaaggatgcccttttactatatatgtgctttctagaatattactgattcttacatatctttaaaagttggatatttgtaatagcttaaagtacagtaacacttattttgtgtaatctttcttaatttaaaaacaaaaaataaatgaacaagtcagttccaatg

SEQ ID NO: 5902 - DNA, 7214 bp, Homo sapiens
gctccggcttccctccaggcggcagcggaagctcccgcaacctccggagcttgtgcgcgtacttcagggaccggcaccacgtcaccgtcacctcctgagtagtcaaaagcaagaaataggaagaaacacaagcatactataaaataaaaggtaactgtcatgtttttgaaggtaaggtgttttgacatatcagcagacattgtgtgaatttatttcaactcctagtggtactggtgtaggtagaaaatgttttgcttggttattcatttcatcaaacactctacttcactgtttttttttcacttcaggaaaattcgaggaggaacaacacatactagtgtctttcctttctttctccccgtcttctgcaaatagtcccttcctcttcctgctttctcctccttctcatgttaacatcttcaaccataagatggtgtgttaaaagattgaatatacctctatggaatgacttccagagggtgtaagtctgatatgagagttttattaccttgagtattttactggaagagatagaacaacaaacattttcataataaatgtgtgggttaggagtgttaggagaaaatacactgatactattactttcaatatttgatactacttactttgactctcactgaacacctatttgtttaggatgaattcactttaagccgggttgaagaacaagcctttaattgtcctattatttgtgccaaatctattataaatttgttaaaaaatttttaatacctaccttagagggtactctaggtatttaatgagctagcatttgttaaaggcttgtatagtaagaattcttatagtaagagttcttaccaatagatggtatattttttaaattgtcctgttgcatcaaaaagttcatctttattggtaatgttgattaagtttgcccatttggtagtttggtttcttttaactatcttactagattttcttacttttacctgaaaagtagtccttactaataggcacatgttttgtatatttccaaaatatgtattatgttaaattctctgtacactttatttaaaaattacagacgttgagggaaaaaaaataccctattaagggaagaatgagtttgtgtataacttgtagaagaaggaggccacccatttttagaaaaatatggatggtattgaaaattttgccatggcaagggataaaaaggacaggcttctctaatgtgtctgaaacaacatttgaatcccctttgttcattccctaaatctgctgctcctttagaattcctgattttcataaatagtaccaccattcacttatttgctcaggcataaaacttggaattttctgattcttcacactcatacaactcatcagacagtaccatcagttcttcctgacaaatacattctgaatttagctacttatcacttccactggtacaacccttgggagccaccatcatctgttgctggaccacagcaataaccacactagttgctatcactttctatctgtaccctcatgaatattttcccatttaaaccattctctatataccaaccaaagcaatcacttaaaaaatgttattaggttatgtcactcccttgtttaaaaccctccaatagcttccttatgcacacagaatgaaatcggaattccttaccatagccttcaagactgcataatctggctcctgcccacttctccatcttcccaggaagcagcacaggaagttgttctcacccttcttactgcctcctttctgtcgtgggctgtgctttttctagtctgtagcagagtctgttagttgtccccaaaaattcctccatttttttcatagtaatagacatggatacatggctacccagaacaaagactatattttgcagccttccttgtagccatgtaatagtgctggctgatgggatgtaagcagtatatcatgtggcacacttgtaaaaccatccttaaaagatagttggtgcacaccttcaatgcggcttttcctttatcctgtaccgtggaatatagatgtgatggcttagaactgtagctgccaatttgtgcctcatgcaagttctctcattctagggatggcaaaactaaactggtggaaaccagggtctgtgagaactttatggatcagagcaccatgctagccctgcagtcgtaaatgtctatattattaaagccactattttggagtctcttgttctcaactgaatttaatcttacctgatactctgtctcagggcctttgcacttgctttttattttttatttatttattttttttctgcctgggatgtggtcttctgtcttggatatggctgactcattctcttccttcaggttaacccaaatatctctgacaggccttccctggccaccgtatctaaaatagctcacgttcccatttattctctgtcaatcacgtgcccctctattttcttaatagcatttataatttatcattatcttgtttattcactgtttattttctacctcccttcaccctacaaaaatataaactacacctgtttttttccactactttatccttcacacatggtaggcattagataaatgctgttaaattagtgagtgaatgaatcaacaaaattcttatccaagattagctagactttttaaataataaatgagtaaatgtcaacagatatccttaacacaaaatttgtaaaatccaatctaggaaacaggaaaaacagtactaaactaataggatattcctgacctccaacttaataaagaagatgtctacctttttctgggaaatctgtaaggctagtacaagttaaaaaaaaaaagactgcactgcagtatatccagggctaaaattcacactaaaaggggtctgaattataatttactagacctcagtttcttcatcttaaatatgtgtaagctttgaatggtaatactataacagttaaaagtttaatagtaagcccaacttatgagtgacaaaacatgttaaacattaatttagtcttcaggcactattttaacaagtggttatttcttgataatactggcaaggattcagagaaacagggctgcttatattgctgagagtgtatgttggcagcacttttctagagtgcagtttggcaatatgtatcaaaagccttgagccatgtgcatttgacccagcgattcttttagaaatgtgtcataagcaggctgggtgcagtggctcatgcctgtaatcccagcactttgggaggccaaggcgggtggatcacctgaggccaggagtttgagaccagcctggccaacatggtgaaaccccgtctctactaaatacaaacaaattagctaggtgtggtggtgcacgcctgtagtcccagctacttggaggctgaggcaggagaatcgcttgaacccggaaggcggaggttgcggtgagctgagatcatgccactgcactccagcttgggtgacagagcaagactctgtccaaaagaaaaggccaggcacggtggctcagagagccacctgtaatgccagcactttgggagtctgaggtggggttggatcacctgagggcacaagttgaagaccagcctggccaacatggtgagaccccatctctactaaaaatacaaaaattagctgggcatgctggcgggtgcctgtagtttcagctattgggaaggctgagatgggagaatcacttgagcccaggaggcagaggttgtagtgagccgagattgtgccactgcattccagcctaggtgacagagcgagactccgtctcaaaaaaaaaaaaaaaaaagagaaatgtattataagcaaataagggtgtgtttaacaagttaattgcaagagtattctttactgcatcatttattaggagattggttaagcaacatccatacagtgaacagtattcagccatttgaaatgatgtggaggaaattttattgacatgatacattgttaagagcaaaagaaaaagttttaaaatacaaatgtttaatttgtaagtctcacaaacatcatctaacgaaatatacacgaggtgttaagtcagccttgcaaacgtaactattttttcattatttttatatcagttactgttattggagcattttatattgactgaggatctttattaaaacttcttcagccttctgtgaaatcttgttatgatggctatagtgacactatataaaacacataaccagaatatgtttatgctcaaatatttcaagcaatatttgatgcttaaaataccaaagtgacaatgaaaatgaaagaaatttggatagttccttagagttatttgtttgtgtttcagatatgaacataaagtatgtttttaatattaccagttttgagaataatagaataaatgccttctcaccttaataagatgttctgttctgactcagtattcatttgccatttatttttcaaatgtagctgaaatctcagtcatgttccaggcactatgttttgtctctgagagaggaaaaaccaaactttttccctgttctcaaatactactcaatacaatacttctgcaacaagatggggtgggatagcggtcccccctcacccccgcccacatcaaaccatcaattttctagcagacatcagctgggtgtctcaattctattcagttctgacactatctacctggaggcagcatcagatcgaacagattgagggctcggttctgcaagactgcccccaccacttccagtaccagccacaagtagtaggttgtcaccgatactcctgaccaagctgtaaatcaggattcccatgatcccttcctcaggttcaattagttcactagagtggctcacagaagtcggagaaacactttactagcatttacccatttattataaaggatattacaaagcatacaggtgaacagctggatggaagaggaatctgcacaccttttctcccataccttgccctatgtataggtagggagaagaggtgtggcaattccatgccttctccaggcaggccagcttccaggaacctcctagtgttcagctatcaggaagctctctgaaccctgcctgtccttttgggcttttatggatacttcattatgtaggcatgattgattacattattggtcactggtgagcaaataacctttaaccccctctcccctccctggaggtgaggagccaggttaaagttccaactccctaatcacatggttggcttccctggcaaccagctcccatcctgaggctacccaggagcccatcaagagttacctcattagaacaaaagattctcctatcgtccaggaaattccaaggggcttaggagctctgtcaggaaccaagggtcaaagactgaatagaataagattctcctagtgccctttatctagaagttttaggacctctgggctaggaaacagagacgaaaactaaaacgtgcatacagaagatagatctatatatataatattataaatcacatcaccttgtcatttagttctcaagaaaactatgtgatgtcagaataatagtataattttttccattttcttgtatgctacatgtatgtagcagatatcatttaaattggtgaaccacatttccccccctttaaatatccttgtccatatattgaatctctctaatactcatcacctttggaattgatcatggcagtattaaaggcacttctattctgaactgaacattaaagatgctattacccctccagtgcttttgtgggtcactatcatctataaaaaatatcctaaaaggagaagccaaataaatgaggtaatcagtggaaagaatataagatccttggaatctaaaaaatggctgtaaccaatcagcataataaaacctctaacaatagaaaaatagttaaccacttagtttagcatctgctaaatggcaagcaccataattacatgatttcactcaatctgtgtaacatttctgtgtgataggtggtatttgcattttacagatgaggaaatggaggctttaagagaggttgctagatatatctagaaaaccccattgtctcagcccaaaatctccttaagctgataggcaacttgcgcaaagtctcaggatacaagatcaatgtgcaaaaatcacaagcattcttatacaccaataacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatacgtaggaagaatcaatatcgtgaaaatggccatactgcccaaggtaacttatagattcagtgccatccccatcaagctaccaatgactttcttcacagaattggaaaaaactactttaaagttcatatggaaccaaaaaaagagcccacatcgccaagtcaatcctaagccaaaagaacaaagctggaggcatcaagctacctgacttcaaactatgctacaaggctacagtaaccaaaacagcatggtactggtaccaaaacagagatgtagaccaatggaacagaacagagccctcagaaataatgctgcatatctacaaccatctgatctttgacaaacctgacaaaaacaagcaatggggaaaggattccctatttaataaatggtgctgggaaaactggctagccatatgttgaaagctgaaactggatcacttccttacaccttatacaaaaattaattcaagatagattaaagacttaaacgttagacctaaaaccataaaaaccctagaagaaaaccgaggcaatactattcaggacataggcatgggcaaggacttcatgtctaaaacaccaaaagcaatggcaacaaaagccaaaattgacaaatgggatctaattaaagagcttctgcacagcaaaagaaactaccatcagagtgaaaaggcaaccgacagaataggagaaaatctactgcaatctactcatctgacaaagggctacaatgaactacaatgtagatccagaatctacaatgaactcaaacaaatttacaagaaaaaaacaaccccatcaaaaagtgggcaaaggatatgaacagacacttctcaaaagaagacatttatgcagccaaaagacacgtgaaaaaatgcttatcatcactggccatcagagaa

SEQ ID NO: 5903 - DNA, 7831 bp, Homo sapiens
agaaggagtgcggtccactggaggtctccctacattcttcctccattatctcactgcctccggtggctgctgggataccggaggactcgggtcccggctcgactcagtcctccagccgcccggggaatacctctagttcttcccggccgccgccgcctccgccccgccgcttcctcctccgcctgccggcctccttcgccccgccccgtccgcgcagctcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaagaaacttaaatcctcagtgtgacacaactcagtccttctactgcagcagctcttttataaaagcctcccaaagctccaagaaggaacaaagaatgtgacccagtaagctcacaccataagtctatattgcagaaacctttgttcaacaaaactgcagatgctctgttgaatccactggagattgtcctgatactaaggacaagtatgctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggctggtcttgaactcttgggctgaagagattctcccacctcagcctcccaaggtgttgagattacaagcatgagccacctcacctggccaagagctagttgttaaaagagcctagcactacccccctctttcttgtttcctctctcaccatgtgatctccacacacattggcttgccttccctttctgacatgagcggaagcagcctgaggccctcaccagatgtggatgccagtgccatgcttcttgtacaatctgcagaatcataagctaaatacacctcttttctttataaattacccagccttgggtattcctttatagcaacacaaacggagaaagacatatgcaatttgccattttaatcatttttaactgtacaatttggtggtattaattatatttacaatgttgtgcaaccgttaccaccatctattaccaaagccctttcatcaccccaaatagaaactgtgcttattcagcaaaaactcccattttcctctccttccagcccctggtaacctctggtaacctctaatctacctcctgtctctatgaatttgcctattgtaaatatttcacataatggtatcatacactatccttttgtgtctagcttatttaacttagcataatgttttcaaggttcatccatcttatagcatgtatcagtattccattcttcttttctatggctgaataataattgtatgtatatactgcatcttgtttatccatttatctttttgtttgtttgttttttaaagacagggttttaccatgttggccaagctagtctcgaactcctgaactcaggtgatccgcccaccttggcctcacaaagtactgggattacaggcgtgagccatcgtgcctggcctatccgtttatcttttgatagacattttggttgtttctaccttttgtctattgtgaataatgctgctatgaacattagtgtacaagtcactgtttaagttgttgttttcaattcttttgggtattgtattaggccattcttgcattgatataaagaaatacctgagactgggtaagtgccaaagaaaaaagggtttagttggctcacatttctgcagtctgtacaggaagcatagcagcatctgcttccagggaggcttcaggaagcttccaatcatgatggaaggcaaagtgggtgcaggtatgtcacgtggcaaaagccagagcaagagaggaagtggggaggtgctgcacacttttaaacaatcaaatcttgtgagaactcacaatcttgatgacagctagagatggtgaagccactcatgagaaaccactcccatgatccaatcacctcccaccaggccccaactctaacaccggagattaattacatttcaacatgagatttgcataggaacaaacagtcaaactatatccggtatatacttaagagtagaattactgggtgataattctgttttacgttttgaggaattgccaaactatcttcctcagcagttaaaccatttacattcccaccagcagtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtattttgtccattaaaaaattgagttatttatcttttatttgttgagttgtaggattctttatgcattcaattcttttgggtattgtattaggccattcttgcattgccataaagaaatgcctgagtatattagttttttgtcagatgtatgatttgcaaacattttctccaattttttgtgttatcttttcactttctttatagtgtcacttgatacacaattttgatgaagtccaatttatcagttgtttcatcacttgtacttttgatgttatatttaagaaaccgttgtcaaacccaaggtcatgaagatttttcagtatgttttcctctaagagttttatagcatttaatatttaagtgttttatagcattaaattttggtctttgatccattttcagttaatgtttgtacattgtgtaaaagtataggtccaacttcattcttttgcttgtggatatctagtttccccaacaccatttgttgaagagattgtccttttccccattgagtgatcctggaacccttgctgaaaattaattacccatagatgtgagtgttagttctggcctctcgattctattccattggtctatattgtctacctctgtgccaagtccatgctatttcaattattatagctatgtagtaaattttaatatcagaaaatgtgagtcctacaactttgttcctcttcagattattttggctattttgggttccttgaaattttatatgaattttagaataggtttttccatttctgccaaaagcgctgttgggattttattagcgtgattacattgactctacatatcattttgagtagcgttgtcattttaacaatattaagtcttccaacttatgaacacaggatctctttccatttatttaagtctactttaatttctttccagaatgctttgtagttttcagtgtacaagtcttctgccttcctggttaaattgatttctaaatattttattcttttgggtactactgtaaataaaaaattcttaatttccttttcagattttgtactgctagtgtgtagaaacacgactgatttttgtgtgttgattttgtattctgcagccttgctaaatttgtttattagctttaagaggctatttttggtattctttagggctttctacacttatatcacttgcaaatagagatagttttacttcttcctttctaatttggatttattttatttctttttcttgcctgatgggtctggctagaactgccaatactatgttgaatagaagtggcaaacacaggcatccatggcttctgattttagtggaaaagcttgaaatttttccccattgagaatgatgtcagtcgtgagtttttaatacatggtctttatcatgttgagacagttcctttctattcctggtttgttgaacagttctatcataaaggaggaatggattttctcaaatgttcttctatatcaattgagatgatcatgagtttttcactccttcattctattacttggtgtattacatcgactgattttcatacgttaaaccactcttaaatttctgggataaatctcagttggtcatagtgtaaaattcttttaagggctgctgaatttaatttcctagtattttgttggggatttttgtatctataatgcattcataggggacatttggctatagttttcttgtattgtctgtctagctttggtatcagggtaatgttggcttcatagaatgactcagaaagggttctgtttctcaactttttggaggagttcgagaaggattagtgttaattcatttctaaacgtttggtagaattcaccagcgaagtcatcagttcctgggcttttctttgttaggagagttttggttgctgattcaatcagaattgaatatcattactttttatagatctattcagatttattctttgttcttgagtcaactttgttggtttgtatgtttctaggaatttgtctgtttcatctaggttatccaattttttgacatatagctcttatacgaattctcttacaatcctttttattcctataaatcagtagtagtgtctttcatttctgattttagtagttgagtattctttttccttaatctagttaaagctttgtcaactttgttgatctcttcaaagaactaattttttgtttcattgattctattgtttttctattctctatttcatttatttttgctctaatccttattatttccttcctctttatggcttcaaactcaattgaacataaagtattaagaaatttgactttttttctcaaatgtctaaaatgtaagaagaaatatgtctagagtcatcaaaaagcagcctgtttgtcagatttactgtttaatccatgtaaacagctttcatataattcatgatagaatattactatgtgctttggaagacactgaggaaagacaaaaggtcattgggcagaaccaccctagattgactgttaaggccatcttctagtttgcaggacttgtggtagacagacagaataatatcctggacctcttgggtgtatacaggacaaactgaaataaactctcatttttagatcataatgtcatcatgaaacatatcaattcggtctatttctgaagaaaacaagcacaatgataaagtttgaatgtttgtctcctccaaatctcatgctgacatttgatccccaatgttggaggtggggcgcactgggaggtgttttggttacgggggcagatccctcatgaatggcttggtgctgtcttcatgggattatgttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctggtgccatgcttctcgtacagcctgcagaattgtgtgagccaaataaacctcttttccttatatattacccagcctcaggtatttgtttatagcaataaaaacagactgagacacatgatgaagaccctttgatatcctataaatattgatttctctccctgagagaagagcatgaatctaagtgatgccattactgtaatgtgaattccacaacttttctcaaagatgtggcccatatgtttctaataatggctttctaagaatctgttctgaaggggtaccttctctctgattttcatttgcatttcctgcttagcttacacacttcaacttgcctatccacctgtcctgaccccaataacctccatcatcagacatctcatcttacctacctactttctacttttcccagtccttcccgtgcttcataaaccatgatcatgagctagagacacaaggtcatagctaaggagttgggatcagaaaatcaccttctgtgattttccattattctcaatacgtaacttcaacaaaatcaagaaaatcatgaaaggacatcctaaggggtcaggtgaggttgcagtggggttagtcggtcaatagtttctttatgccaattaggatttctgcagaaaacaatgaaacactggtttaaacagtaaaaatattttaattccttacagaagcccatggaacatacactccaggtttaattcatcagctcaatagcatcatcaacgacttaggttctttccactttctgcttgtcatctgtgttggctttattttcaagctagctcctccctggttgcaagataattgcagcaggtttagttatcatattcggacatgctaacgcccaggctagtgatcccttccttacatttctttctcattttaagaacaaagtgtttaaaaaattatacttaaaattattggcatctctgtcaattgaaagatgtcaatctctttcatttttcctaatcactaataacatctactaaaaacaaaatgtctgtgtaaataatttatttgaataaaattaaagttgttgagtgagctcggcttttgaggagtgggaaaggaggggtgcatagattagtggaagatgagaagctagtggggctcaagtccagcaggagcaggagtttggagccaggacttcctagcctctcagggtttttttttaacttccttacctgaaatgatttgtgctatataacttgtcctggctaaactttcttaatctcaactgtttcatttaatcaataacaactactgcgccaccttcataatatcaattttcagcatttcatttactgaatatcatttcctttccttccagactattctactgtgtcaaattcaatattcctttgactcaataggatctccaatccagtgaccccattatttgtttgtttattaggacaagaaaaacaaactttcccagaaactccccagtagactgctcctcatatctcgttggctagaactgagttgcgtgcccattcctaaaacaaaactggcaagaaagatagttaccaagattggttcagaccaaatcaggattttttcctgaggagaggataaagtgagcttcccgggaggcaaatatttacacattccaaagattccaaagaaaaaaagagaataaatactgggtcgttaactaatagtaagtggtacggtattacaggtaaaatttatccttttagccctagcaacaagtgacaccttctgaagccattattcatttgtcaggaatagggcaagtatcaggaaaagaaacaccgaaataaactctgtttccatttattgcattctagcactggttctaccaaatatttgttggatgactttaggtaaagcatctagcctctctgtcttgattgccacacccacaatatgagataaatattattctgcatacttcctgggagagctgggaagataaaatcagatcattataccacataaagcaaagcaataacacttccatattttagcttcccacactgcctatctgtcctattttcatttattcatttatactttttaacaaacagttgctagtagtttgcttaatgtaagatatgggatgaatattttcatgatggcccctgcatctaagttatcatttagcagtacctgccttatctcttgtacagaatcagattagacagcataggaagaatgaaaaggtgaggtgggataataaggaatgttgtttgtggaaacataatggttgcttcaatttgagtgtaaactgtcctttttactgaagcaattgcaaccaagtgtgtgagttcacaggtgcctacattgcttttttgg

SEQ ID NO: 5904 - DNA, 1882 bp, Homo sapiens
gagttagggtcttgctctgtcatccaggctaaagcacagtggtgtcatctcagctcactgcagcctcaacctcccaggctcaacagatcctcccacccagcctcctgagtagctaggactgcgggggcacaccaccacgcctggctaattttatttttttgcagaggcaaggtctcactatgttggccaggctggtctcaaactcctggactcaagcaatcttcccactttggcctcctaaaggctgagataacaggcatgaggcaggagaattgtttgaatctgggaggcggaggttgcagtgagctgagattgtgccactgcattccagcctgggtgacagagcgagactccatctcaaaaaacaaacaaaaaaactggctttaaaaaaaaaaaaaatctgtaagggtggggggagggtctccagaaaagaataaaatttttaaaaattggctttatataatgtctgactatacttttattctaaaaactctgtgacataaggctggtaaacagaaagaaaaatccaacaaggacttacttgaccgtaggacatattaagatgtttattatttactaagagtaacatgtatacatttgcagtaatttgtacaatccaactacattacaattcacagtaacatacactagctctaacctgccttggatacaattaagtctcctcaacacactattttatcgccaaacttacattctggcttttataatcattttgcaacacctggtacagtatacacctatagctttgccatagaaatgcccctaaatgcccttcagagagcagaggtgaatactttctcatgaagaaacgccaacttttctaagcgagttcgtttcagtagtgggagccattcccagtaggataactctaccacacggtagccaagccgagccagctgccgcctcttcatattgtgcagtccaaggagatccctggagccatagcaatactggttcctgtttgtgaactgaacagccagcttcattcttggggtctgcatgcaggctgcggggcacaggccagccatctccatggcccctgatttatctgctacattgcaaaggaagccccccagaggtacagctgccttattctccaactccatgggctgctgcccaggctctgactcagttttgccctggaaatgtcctcttgctttcccttttagtaacttattcatcaaatcatctgtaaggctgactcccacatgctcaagccttaatttggctacattttcagccggcgtggcttctctattaaatggtaatggcttcaggttaacatcaagctggacctctaagtcagaagatcgggtatgaggcaaaatcatatggtgcttgacgtactggggcccccccagcatggtctccagtaaaaagacagtttctaagaattcaggctttgaattcatatccttctctgctaaataccacagcaattcagacccctcttgctgaaggtgagtactaagacgattgcctctgtaatctggacactcaatgccaactgtaccatcgagggtatatagttccttaaggaggtcaaacttagttctctcctgagctaacctgacaaaccctggactgagagcgaaatcaattaactctactggaaagtactccaaaaatgccaggcccagcaggcaggtgggcaggtgttctgggtactggttgaattcaggcatctttctgtgaatctcacttatcaggctggagtaaaattcttctgcattgggtggcttataattcagagttccaaatgaccacagaatcttggcaacatctttacttcgacagtgtgccactctaggaggcaaagacgcagccactgcattcattactccttcattcaggaagcgta

SEQ ID NO: 5905 - DNA, 1439 bp, Homo sapiens
ctggcctccgccctacctcccagtaggtaccagttagtgatccagctcagcttacagaaaagatctcagatctgagtggactccgctaatgcctgcagagttagggcctcctggaaggcaagggaatggccaataaatggcatgtgacacccagggaacagcttctctatctatccctagggctctgaggctggcagaaggctgctgagccaaatgctctgtggctaaaaggaatggggcggaaacccacagatctgcccctggtagaggggacatcagggaatgtctgtctgattgtcatgaggttttaagggcagaaagatccctgccaggtcatctaaacccctggtttatcagtgtgaaaactgagccacagagaggaactggcttaagtctctaggccagctcccctttgcaggcaccagtgtgtcccagattggccagatcacaggtattttctgggggcatctgtttaaaaattggaggcctaggcccaactccagatctacagaatcagactccaggagaggggcctggtgatctgcatttaaacaggtgtcccaggtggcctgggtgtgctagcatgcctgggaagcactgtgtctccatctcaaagtatcctcctagaagttcccacttgaaagctcaagagaagacctgggggtccattgtctctggagagggaagtgtctgggtccagagctaacaaatgcccacctcaagcagatgctcctgtttgaggggtgggaggtatctccccaagggcatcagtctgctgctaacagagaggactggtgctgtgtagctattgctgcattttatcctgccaggtgggtgcactgcacccctttacagatgaggaaacaggtgagttgaagatgaaagaaacttgtccagactcacctggctgataggtggaagaatagagatttgaacccaggactgtctgtccctgaaacccacacactttgaccacacgccacactttatcctctatcacactgaatttacatgagcaaaactgtgtagtgacttctccagcaatggaggtgtctgggcagcagctggaggagtcaataccagggatgagacgatctttatcagcccttctggagctgtggctgtggacaggctaagctggctacaggatgcaaggaagtctgttgcatttcttccatacacagataaaaatgctccagattatttataggttctagtgcatcaaagtcctcctggctcaatccttgaccacgctggagctgccgggcaggaggcaactgggaacccctacctgagagggaattgctgggggcagaggcaacgaagcacagggggctggcaccccaggtggtgacaagggcaggggtcaggggttgtgacgggaagtctgggtgaggccagggaccagagaaaactggcaggggctattggcaagggcg

SEQ ID NO: 5906 - DNA, 18812 bp, Homo sapiens
agactacagacgggggagcctctggggctgcagacactgcagacggacggacagacagatggacaacagctggaggcttggccccagccatagggctctctgcgggacagtcccagctgctagtgttgctgttgctgctactgacccgtgtccagcctgggacagacgtggctgccccagagcacatcagctatgtgccccagctctcaaacgacaccctggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccaggccagaggccagctccatgtcctccgtgttggcaatgatacccactgccaaccaacaaaaattggctgcaaccatcccctaccaggaccgagcccctacagggtgaagttcctggtgatgaatgacaaaggacccgtggctgaaacaaagtggtccagcaacactcgcctgcagcaagcttcaacagctgcaggagcacttccctatcaggcccagaggagacagggagtgtgagaagatacaccacgcacctcgcgttcagcactctggccgagggggattcctgaggggtaccagaggggcccacgtgtccctacacctcctccctggcccaggctgcagagcctgggctgggacacgccctgaagcttctggaccctgagagagattgtttcttttctttactttttttttttttttttttttttttgagacggagtctcactctgtcgccaggctggcgcgatcttggctcactgcaacacgggttcaagcgattttcctgcttcagcctcctgagtagctgggactacaggcacacgccgccatgcccagctcatttttgtatttttagtagagatggggtttcaccatgttggccaggatggcctccatctcttgaccttgtgatctgcctgactcggcctcccgaagtgctgggattacaggcgtgagccatcaagtctggcgagagagattgtttctagatgagggtgggggcgggtgtccttagcccaaagcttgtgccagtctctatcagaaataaatgcccccaacacctccctgcctgcctctgacatcatacacctgggtagtctttctgcaccactgcccctggctcctcctcctgaggaggtccccaagggcgtgtaggaccagggcaaggctcaggatcctagagaaattgtcacctggggcaggacaggtctctctgccagccttactgtccctatctgtaaaatgaggatggtaaccctgaacccacaaggccacagtaaggctaaaccaaggtgaacatgccttgggaactgtgaagactgtggacccaaagccggttgcggtggctcaggcctgtaatcccagcactttgggaggctgaggcaggaggatcacttgagcccaggagttcgagaccagcctgggcaacatggtgaaaccctatctctacaaaaatgacaaaaaattagctgggcttgttggcagactgtggacctgagataggtgctcctcttgtcctgcccagacagcctcctggtaaccaaaggccacggggcagcatggctggcacttgctatctttccacccaagcatcctccctgtggcccctctccccagcctgccccctgttggctggaggacttcaagccctctgcctccacttcctccaatcctttcctagagtacacgaaaggcaaaaggtgcagtttcttttttttttttttttttgaaatggagtttcaccttatagcccaggctggagtgcagtggcaccatcatagctcactgcagtctctaattcctgggctccagtgatcctcccacctcagcctcctgagagtagctgggactacaggcacatgacaccacgtctggctaatttttaatttttttgtagacatggaatcttactctgttgcccaggctggaaagaacagtggtgtgatcatagctcattgcagcctcaaactcctgggtgcaagcgatcctcccgcctcagcctcctgagtagcttggactgtaggtacatggcaccatgtctggctaattttttaaatttctttagagacggggtctcactatgttgcccaggctggtctcgaactcctggtctcaagtgatcctcctgctgggattacaggcgtgagccactgtgcccagctcatgcaacacttatcatcaggattcccactcagtgctcggaccccaggggccagagatgcccgtggcaaggttctgccctcaaggtgcccactgctttagggggaggacagtgatactaccacatacgagagaaggagaggacacaactgtcagggagatggactgtttgagcttcagaggcagcatcttggggaggggtggctttgaagaaggagcaggacacttgggccaggtggaccttggaagggtgccaggcaggaggagcaatgtgttgctgatgggcaggtaggggagggtgagggatggagaggagaccggaagacaccctgtgccatgtggaggggccccgccctctggggcaagaggtcagggaggagggcgctggctgggttcccaggcgcctgcccctgagaggcgcaaatggccctaatggggttattaggtggagcagatgcatccggctcctgctgtggaggaaatgctcaaatgatcttgaagctaccaggctgggagaggcaggcaggggatggggcagacaggctgccaacctctgtgagataagccctggcctctccagaaccttttcagaacagctttgagccccaaccctggggctgagtgacccaagacagatcactcacactctctgggcctcagtttccccttacataaaaagcaatggttaggccaggtgcagatggctcacacctctaatcctagtgctttgggaggccgaggtgggaggattgcttgagaccaagagttcaagtccagcctgggcaacatagcaacaccccatctctacaaaatataaatacaaaaattaaggctgggcatggtggttaaggccaggcgtggtggctcacacttggaatcccagcattttgggaggcagaagcaggaggatcacctgaggtcaggagtttgagaccaacctggccaacatggtgaaaccccgtctctacacaaaatacaaaaattagccagccatggtggtgcatgcctgtaatccctgctactgtggaggttgaggcaggagaatcacttgaacccaggtgaaggaggtttcagtgagcccagatcatgccactgcactccagcctgggtgacagggaacaagactgtctcaaaacaaaacaaaagaaaaattagccagacatggtagtgtgaacctgcagtcccagctactatggaggctgaggtgggaggatcgcttgagcccaggagttggaggctgcagtgagctatgatggcacccctggacgccagcctctgtgacagagcaagaccctgtctctaaaatgaaacatttttaaaagggaaggtgaactgggtgaactctaagaccctgcatttcacaaacccttgcccacaccctgtatgcgtcgggccctggcaggaaacagagggtacgctgtctcacagggcaattgagagcgtttacaaaggtgtgggcagcattaggggaatggaccagagagggtgacctgggacttggctgtaatggggccctaagcactcctggatctgattgctgatgggagggagggagtgatgtttcctggatcagcaggcagtagccatgggtgaggggccccgcaggagcaggggctgtaggtgaaaggatgaagccaccagagggaactgggctctgtcttcccgccccctgatctcatgccagtgtctccactggccacacctcacgagaagcaagagagtgtggggtctcagtggtgcagtccctggaggccaatctgctgggtcagagcaggacagagaaagcgaaatggacatacagaggcacacgccactttcatgctgatccagtggaattagatccttcctgttctttcttttctttctttcttttttttttttttttccttttttagagatggggtctcactctgttgcccagggtggggtatggtggcgtcttcatagctcactgtagcactgaactcctgggctcaggcgatcctcccaccttggcctcccaaagtgctgggatttcaggcactacaggcacctagctaactttctttctttcttttttttttttttgggtagaggcagggtctccgtcacccaggcttgagtgcagtggcacgatcatagctcactgcagccttgaacccctgggttcaagcaatcctcccacctcagcctcccaagtagctgggattataggatgtgccaccacccagctaatttttttattttttgtagagatggggtctcgccatgttgcccaggctagtttggaactcctgagctcaagagatgctcccaccttggcctcccaaagtgctgaaattacaagcataagccaccatgcctggcctcccttcctggccttctggtctccagactggagagagggccacaaagtcctgcccagacagagggctgctaaggctggggtggggctgggggtgtgcagaagggactctgcaggggctgacctctgagtctcaggggacagggcaaatttttttttttttttttttttgagatggagtcttgctctgtcgcccaggctggagtacaatggcacgatctcggctcactgcaatctccgcctcctgggttcaagtgattctcatctctcagcctcccgagtagctgggattacaggagtgcaccaccatgcccagctaatttttgtatttttagtagagattgggcggggtggggggtggggtgcaggtttcaccgtgtggcccaagctggtctcaaactcctgacctcaagtgatccttccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctgggtagccccctacccacatgcctcagcattgggatgtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtggactaatgacccttgtccctcccctcagctgcctctcttttttctttttttttgtttttgagacagagtctggctctgtcacccaggctggagtgcagtggcgcgatcttgactcattgcaacctccacctcctgggttcaagcgattctcgtgcctcaccctcctgaatagctgggattacaggcacccgccaccatgcccggctgatttttgtattttggtagagacggggtttcaccatgttggccaggctggtctcaaactcccgacctcaggtgatccgcccgcctcagcctcccaaagtgctgggattacaggcatgaggcagctcgcccggcaaccctcagctgcctctcatatgtccttggccccctggccatctctgaccagacatccaggaggcccctcctgccaatatgcttccccgacagctgagcccaaagctgcctccagccctgcaccttgtcttggttccctgggtgctccctttcccaggctgaagcctggacagccccaggcaacctctctccctggccacagtaccacccggccacatgccacactgctttctacagcagacaccgcctggccacaaagacttaagccacttccttgggtcctgctcagtgctgagcccagagcccaatctcggactgggagagagcccagtacatggccagtgggattctcccgatgaaaatcccagccatgcgaggctggcttctccaggttctctggggcctgtgagtccagggctggctggagggaaagcccctggccccttaaagccactgatcatgttcccagagagggatcctgagaatcccctgggagagaaaatgtcggagccccagtcctggcccccccttgaccggcttgggcctcagcctcctcatccatgaaaagaatggacaagaggggtctgggtgcggtggctcacgcctgtaatcccagcactttgggaggccgaggcaggtggatcacgaggtcaggagttcaagaccagcctggtcaacatggcaaaaccctgtctctactaaaaatacaaaaattagccgggtatggtggtgcacgcctgtagttccagctatttaggaggctgaggcagtaggatcactggaacctgagaggcagaagttgcagtgagctgagattgtgccacggcactccagcctgggcaatagagccagactccatcttaaaaaaaaaaaaaaaaggagggacaagaggcaccagaagctcctgtccaggtctgggcctcccttgggtcactcagttctcccccattcattcattcattcattcactcactcactcactcactcactcactcattcccacactctgcagccactgacttcagctagccatgctggatgctaagacatagagtcccggccatcaaggccagtccatctcagtggcatctagacatgcacagagatgaccagggagcccttgagggacagagaggcacaccctgcctcctgatcccatctgggggctgcatgaaggaggggcacaggtgtggccttgaaggctgggtaaggggctgggagggctttaggggcattccagggggcaggcacagagctggaggctctgccaggcacacccacaggagagcaatggctggagggtgacatggactgcagggtgtggccgcggcagcccagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctccgtgccccctctcttatgtctctcacgctgtctcttgtccttgtttttaactctgacacgccgtgggaactcggctcacttcctagggggaagctgtctggactggcccagagatgggcaccaccatttcccaataaacacaagataaaatcagagagctggcgtcagttccacggctggactcagtggggaaaagggcaaaaagcagcagaaataagagcagggaaagaacgggctgggtgcgatgggtcccatctgtaatcccagcgctttgggaggcctaggtgggaggatcgcttgagcccagaagttcaagaccagcctgggcaacatacggagacccccatctcttaaaaagttttaaaaattagctgggcatggtagtgtgcatctgtggtcccagctactcaggaggccgaggtgtgaggatcgcttgagcccaggaggtcgaggctgcagtgagctatgattgcatcactgcactccagcccgggcacagagcaagaccctgagaccttgtcagaaagaaataaagagagaaagagagaggagagggagagggagaaagaaagggagagagagagagagagaaagatgaaagaaagaaaaagaaagcaaagaaagaaggaaggaaagaaagaggaaagaggaaggaaggaaggagaggggaaggaaggaaggagaggggaaggaaggaaggaggggaaggaaggagagaggaaggaaggagaggggaaggaaggaggggaaggaaggagagagaaaggaaggaaggaaggagggaagggaaggaaaggggaggggaggagaaggagaaaagaaagaaaggaaaaagagcaagtggatatcaggggacagaaaccattcgcagcccatccctcagcagatgcagagggagtcagcctggaacccccacccctgctggctgtgccccacggctgtctccacaccccagcccttcctccagacacccagccgtccactgcagcaggagcacaggtgccccaaggggaccactgttggaaaccaggcagccctccactcacccacacagtgtgtctctgcaccccctctttgacatgggagccggggcgctcttggaaataagggtttacctgaggggtctgaagacttgggcagtggggggctgtgaagcctcggggagggaatcagcttgtccaagagtctggggcagcgagtgggcgggggctacccggtctgaccccatcaaagtaaccttcctgggggatatttccattgcagggtcacaaaaaggcaagggctatggttcgagagaggggtctctctggggtcccagccaccctgctgtgggggcccttcccaagcaggacactccaggcaaaggggatggcttccccttgctcccaggacccataggtgaggtcctggctgaaatgcagactgtccccagatgcccctggggacttgtagggatttgggggattcagtgttgcaggagctggaacccctgcttgctggacgggtttgagctgtgctgtcgggcccaaggctcctgggtctccaggatggtgcatgagggctcacaccagctgctccctgccacccttcccccacctcccaccccttctcctggagccccagtcctctggtcctccaagctcagcttcaaatgcttccatcacttctgtctcttctaccttgagtggtttgtcaacctccaaatcacacggagttcaagaatatctcaaatatcgaccaggtgcggtgtctcacacctgtaatgccagcgctttgggaggccgaggcgggtagatcacctgaggtcaggagttcgagaccagcctggccaacttggtgaaactctgtctctactaaaaatacaaaaattagccgggcgtggtggtgggtgcctgtaatcccatctacttgggaggctgaggcaggagaatctcttgaaccagagaggtggagattgcagtgagccaagattgtgccactgcactccagcctgggcaacagagtgagactctgtctcaacaacaacaacaaaaagaatatctcgaatacaaaaattagctggctgtggtagtttacacctgtaatcccagctactcaggaggctgaggcagtagaatctcttgagcctgggtgacagagcaagacgtcatctcgaaaaaaaaaaaaaagagtatatcgaatacaaaggaatatcttgaatacaaaaattagctgggcatggtggcacacgcctgtaatcctagctactcaagaggttgagacaggagaatcgcttgaatccaggtgttggaggttgcactgagctgagattgcgccactgcactccagcctgggtgacaaagcgagactgtgtctcaaaaaataaaaaaatacaaaattaaaagaaagattatctcctggccacccatggtgcaggctgtaatctgtctctgctggggtgaagggacggagggagacaggtgagaaatgagaacacagacctggagactcagaccacccatgccagctacccaggtcacttcagcccagcccagggagcccctgcccagcacaagcctcatgcacagtagcagtgttaagatgggcccttgggccgggtgcagtggctcacacctgtaatcccagcactttgggaagctgaggtgggtggatcacttgaggtcaggagttcgagaccagcctggccaacatggcgaaaccctcgtctctactaaatatacaaaaattaactgggcgtggtggtgagtgcctgtaatcccagctattcgggagcctgaggcaggggaattgcttgaactcgggaggcggaggttgcagtgagctgagatcgcaccactgtacgacagagcaagactccatctcaaaaaaacaataaaaagaattgctggaggagggaagtgaggggcggctggcgggggactgctgggctggtgcagagggagtcaaggatccctaagagagaggcaggggtgttcagctctcccacctctgctggatgaacttgcagagcctccttggtgactgagctggtgcagagactctgctcaggacaacacccttgcctgggacccccacatctctggccccagcagcagcccttgggggggtccctttatcttcctccactcctacccaggcttcctcagcaggagatgaggcaggatatttccactccctttctggaaggttcagaatgttaatgagagctaagcacgtaagtccatttagggggatgaacttctgggaagagaggaacctgggtctgggctgacggccaagggcgggctgggtgacggtccctctgatcacggagcctgtccacccgctgcccagggccctgcctcgacccctctgaccagccactgagccccagagggatctccatgaatgtcagagacattgactggaggccttatctccagtgggagaccccttctcttcccaccgtgggccggttccagcctgggctgtccaggaagtgacctctcagggcctgggaagggtgtggccaatggttcttggttgtactcaactcatctgccttgggtctaaggctggggtgaatggaagggcccacctggaccctggagggacaccaggctcgtactaagatcccaaaaagtgaaaagctttcctcaggcccaagcagagaaactggaccttgaagctacatctctggacttagtcctcaaagtaggagacatttgcctctaagctgttctctcctaccccacctttctgtgagccgccggttccctgttgttcacatcaagctgtgtgctgggcactgggtgcaggaatagcttgaccacagtctctatcctgggggtaaaggggtggccagcccacagagggatggactgcaaacagacagtcccaaagtgccatgagagaagctctcagggcctgggcgtgatggttcatgcctggaatcccagcactttgggaggccgaggtgggtggatcagttgaggtcaggagttcgagaccagcctggccaataaggtgaaactccatctctactaaaaataaataaataaataaataaataaataaataatacaaaaattagccgggcatggtggcacgcacctgtaaacccagctacttgggaggctgaggcaggagaatcacttgaaccccagaggcagaggctgaagtgagccaagattgcgtcactgcattccagcctgggtgacagagcgagactccatctcaaaaaaaaaaagaaaaaaaaaagagagagagagacagagagaggctctcagcctgcaggaaagggctctctccttgttggccaacccagtgggccctttagctgtgacgggtgtgccctgggcccaccaggacaggagcaaggtcaggagggctgctctgctctgcaaaacagaggctgatggatctgaagtttctgttactgggagaataaagggaggtgaaggagacacgtggtaggtcccctgggaaggtggtgggaacgcgtgtgaaatgctcggagaggcacagtaagaaccggcctgtttagaatccagtgttctacgcctgccccaggccccagcaattctgcttctagacatctccccatgagaaatgagcactgagcctcccaaacatgtcttttgggaggccaaggggagcggatcacttgaggtcaggagttcgagagcagcctggccaacagggtgaaaccctgtctctactaaaatgacaaaattagctgggcgtggtggcaggcgtctgtaatcccagctactcaggaagctgaggcagggagaattgcttgaacctgggaggcagaggttgcagtgagctgagatgacgccactgcactctagcctgggcgacagagcgagactccgtctcaaaaaaataaaataaaataaataacagccagagagaggcagccctgtgccccatccagagcagagaggaatgtcagggggtagtgattggtggtgaacagtagggtctggcacagggaaaacacatcagtggcagagccagttgttataggggtagggggagatacaaggaaggtccaagcccagggcctgggggtggcctgggcacatgctgagggttctctcctgcaggacagccacagtgtggaagaccctgtgccccttctggggtgaggagtaccaagtgcacctgccgcccaccttccacgctgtggctttctacgtcatggatgaggatgccctcagccgggacgacgttatcggaaaggtctgccttacaagggacaccatagcttctcaccctaagggtttcagcgggtgggcccacctgacggaggttgaccctgatgaggaggtgcagggcgagatccacctgcggctggaagtgcgcccaggggcccgggcctgccagctacgctgctctgtgctggaggccagatcatgaagaagtcatgctacccacgctggaatgagacgtttgaatttgagctgcaggagggggccgtggaggcgctgtgcgtggaggcctgggactgggaccttgtcagccgaaacgacttcctgggcaaagtggtgatcgatgtccagagactgcgggtggcgcagcaggaggagggctggttccggctgcagcccgaccagtccaagagccggcagcatgacgagggcaacctgggctccttgcagctggaggtgcggctgcgggacgagacggtgctgccctccagctactaccagccactggtgcacctgctgtgccacgaggtcaagctgggcatgcaggataagctgagactcctcaggatgtggttctgcagcagatgaggtgcgaacaaagcctgctctgccctgggcacccaggatggcactgagttctaaaaggcaaagggtatgtggtgaggggccaggctgaggccctggtgtggtaccatcatgggcagcagcaccatttgaggccgggtaggagagacgtgcagggcctggccccccaagagaccagcagacaaactgaggcggcagagagagagattccagtgtcaccaggaagactgcagatcataacaacaatggttgctgatttggcatcaaagaggtggcactgtcaaagccgtaattgctgaaaatggcaccaacatgctgcagctggagagagtgggtgaccaacatttgtttgaagaacagatgatgctctttgaatggctcagccaacagcccaaagttttaagggaagacctctctgccagcttctcttggacagtgtctcatgtaaaacctccaaggcacttacatagcatatttttgtgtccactctcttgctagtctgttgtacctggaataaaaaagcagaggaagtgacaccctcacttgaaatggtcacttcccttcaatgtgctgcagagaacaggactgatgtggggaatgctgctgctgctgcttgtcaaacatctacggctgatggccacacattacttcttcaaatgaccttggacctcagagccttcactataagtaggtacatggtacctctcccagggatgttgtgggacccatgaagagtccgctgtctgtgatgtgcaaggtgctctgagtcaggtgcagcttgtactgctataggagcctaagaatctgcctcacctacactccctctgggcaattaggtatgctgaaaatgcccaacagacattcaggactacattggtatctgtttaaggaaaatcctcagctgctcacacagtaatgaaagagacaagctagaaaattactacttgataagactctgccacagtctctccagaggggaagggagaaggggtggatcacagcaccatgaagcatgcttatgatttttcaaccaaactcccttgaacagcagttgtactccaatgtggtgaagctattttagcatctgtcattgtcctgctcagcacactccactcccttgctaaaagcttaaaaggtctctgggatcctaagcatatttaacaaagatttaaaatgctcaggcaccaggtagcctctggtggcgatgtctggacagagctgcagctggtgagcacagaaggggcttcttcacattgactcagataaacaacatgcaaaacagcagctaagcctctgactcaaattgaggcatcaaggccaagtcaaggtagtaagacatagcaatatcacaacccctcagctaaggggtctgatgcagatgcaggactttcgagtaagtcttgacaaaatgcacaacctggccaagcgtggtggctcacacttggaatcccagcactttgggaggcggaggtgggtggatcacctaaggccaggagttcgagaccagcttggccaacattgtgaaaccctgtctctactaaaaataacacaaaaattagccacatgtggtggcgagtgcctgtagtcccagctactcaggaggctgaagcaggagaatcacttgaaccccagccttttctccacaaggcagcagagtgattgtgtcggtgtggcgatccccacaacggcgtgcagaccctactcctggggccatccgtacccctctggcctccttcccaactcctcacaggctcactcccctggggcagtttcctggggacctgtccgccctcttgctgagctcctgcagttcccctttctcagggcaatctctccaccaccctggctcctgctgccaaccactgcttgtgctccttcccagtgctgagtagctcacatgctaaatgccctgtctcctccacaggactatgagcctcagggcaggctcggccacccatgcagagcccaggtgagaaggagtacgaggtccaagggtccagggagtgagacgacctgcggtgcacaagacatgctagggcagggtggtcgaggcagctccctgggcttctccttccctttggtggcactgctctctaaagctccactgatgggatggtgtgtgcatgaagggcaaaggaggcttgctattcttttaacttaataaagaaaagtgaaggtgtgactcaccagtcctaaaccagggtgtgtccaccttggcactattgacacttggggctgatcattatctgtcatgggaagggtggctctcctgtgcactgcagggaatccctggaataccctggcctttgccgactagataccagtagtactccctcaccacggttttgataacccaaaatatcctaagatgttgctcaaatgtccctggggcagtagcaaaatcaccccggctgagaacccctgtcctaactctaagggactgcagagaagggagccagagcctggagacatgaccagactcagctacagtcacaaggagaagcattcaaactgtggcctcagtaaggccagcaccagctcaccccactgacccttgatcacaacaggtgctaattcccaaagtccagtaattaaagtcctgggaaactctcaccacagggtggagcagtgggccctcagagaaaccccacgtacagctctttttacctatacctgacttgaagggccccttgtcacatgctgtccttcatccaaacatcaggggagttgggagagggacctcacctttgggggcttgaacgggtaatctgtaggaaagtggatggtcaggaagaaaacacctccttggtaaggactgtcattctggaaggatgagacacagaaagagatcagtgcatgtgctaagcccaaagtgcaagaagcaaaactggagtggtgcgctcagcagctactacctaccgggcccatgatggtggcctgccagtggaacactacaaaacaaaagagagacgggcatgtaagagaccccccaagaaacatgtcattctactgaaaacgcactgctaaattacagcgcactgtctacacaagatgcactcacttctgacaccaactgcaagactggggttccccaaaccacccaagatgcaataactgcctaggactcccagagctcactgaaagtggttgtgcttaagattgctggttatcacagggaaacaacataggttaacatcaggagggtccaaacgcagagtttctattcttctctctccgtggagtcaggatgtgttactctcctggcattgctgtatggcaacacacacagaacacccaatcaggaatgctcactggagcctccgtattcagaattctcattggagctccaccctgagagcatgactgacttatttgaatgcccataggactgatctcaggctccagtctccagctcctccaggcatgatccaagcccccaccttattttattttttagttttttgagatggtctcactctgccacccaggctggtgggcagtggcatgattatagctcactgcagtctcaaactcctgggctcaagctatccttctgcctcaacctcctgaggagctgggacaacaggtgtgtgccaccacatctggctaatttttttacttttattttttcatttttgtagagatggggtcttgctatgttgcccgggctaggctctcacctgaaatcacatggctggtctacttggtatggccattcctcaccctaaatcacattgttggtgtgcattaaagcttccagccaaacaaagacattcctatcaggtatggtatcttacagatcgccccctacgtgttaaggatgaaggccagatcttttggggacaagattaaattctttttgttgttattgttttgtagagatggggttttaccatgttgcccaggctgggctcaagaaatctgctagcctcagcctcccaaagtgctgggattacaggcgtgagacactgtgcttagccaagattaaattctttactacacaaatgccagtaactacaattcagtcagttctttgcacagaattaagccttggctaggcttcagccattttccttattgctctttataaacccttctattccttggttcttctcctgattcattgtgaagccctcttcaaagagtgtctctcaggagccaactgcccgtggccctggagcctcaagggtgctgccttcatctgagtcctctcctgcccaacccctgggcagtgccctgtgctctaggcactcagtaacaaggtcacgatgagcccctctcatgcttcccttccaggtcaccaccatttggtgagagtttagagccccctcttgctgcacatcacaccctctccagcatctcaggtgactttcactgctctacccattcccagaaaagctcctgtgtatcagcaaggctagcccagtatggcccaaacactcacattcaaggctcccaagtcatacaaatggtcccagggatattgactctagggccttggtggaaaatgcctactcacccacaggagtgggttgctgggatcatctgaagggcctgttattaccaagagaattctgtctcatatggattcatagtagatatggaattagcccagagtttcagacctggtcctgtcctgggtttcctgtcacctgtttaagtaccccacaggctctacacaacaggaggcctaggaaagcaccaaggtttggggtgggagcacaagtgcagggactaaagcagaagtttcccaagcccctagaggtgttcaaaagtagtcaaggtggcccatgagcccttttcaatatttcaaagaaatggtgctgaaaagaacacctttacctgtaataagcctgcctgagttaataaaaatatcacttttttttgcttttgactgtttttattccaattcatgctaatcgttagttgaaagtagacatattttgcctaacattaatgtgaatggaattctttattaaataaaagtgttttgataatatatttcagaacggaaggttagaatcctctggtcttgttcactttaaccctgagggctgctgggacactaagcagtgcttgagagcagagtcagaagagaaggccccaaaagcaagaggacgagaaaggatatacaggagggatgctggaaatggctgtgagcccatgaggcgggtgtgaaatggccccaaaggctagcttccagtgctgtctgaacctcatccactgaggtctgactgtggtggctagccttgatgctagcctctcttagcactgggctctggtgcaaggtaaatttgagctgagctgagcatcaaggagctgcctctagacaggtaaggctaaacaagaactagttcaagcttacagcgaccccagtttaatctgatattatcttaagtgacaggtaagaggggaagcatgctatggagacctggggtgcttgtgaggacgacatgaggtaaacactgattagtggggagcagagtgatgagcaggtaccaggagacagtggagcagagtcattcttgtttcttacactctgcataggcagctgggaaacatttctgctctgctccagaaatgagatttaaactcccacataaagcctttagagtcctccattttcagtggctccatctgcctaccgctggctcctctaagctcagtcccctcccaggacatgcaggcacacatatgatgccatgccctccttttttccag

SEQ ID NO: 5907 - DNA, 568 bp, Homo sapiens
aaccacaaagtaactttgattaaaggaggaaactggtctacttgttgaaaatgtggtaatgagatagtttccacccagccgggaagcgtggcccggagggggaggggagcctgcatttcttcatgcctctacccatcctgaagaaggtagaaaggaacaggcctggctcgacctccactttggagaagatgctccaggaacactgaagggcaggtcgtccccgaccttctatgaggattgcccagctcaagtattgtttggagccaggtagagtgaagtcctacagagttatcaggttccagaccctgccttctcttctgaaagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctct

SEQ ID NO: 5908 - DNA, 7169 bp, Homo sapiens
cgtgtaagaagtgccttttgcctcccaccgtgattctgaggcctccccaaccatgtgcaattgcacaggcccaggctgaagaggaaagacaagagccgccctgcccagaaacgtccacatgtgggtactgcattcctaccggtgtgacagcttgaggcccccacgcccgtcacagtggcaggtgtagctccctggggagttcacgcagacctgctcacagcggccctgcagacactcgtccacatctgccagccagagggaagcggcggtgagccggggaggcctctacgctgtcccgccgtgggatcacaccgcgattgctcaaaccacacgcaaggtcctgccatcagaggagagctcgaagccgctgtggcaggaacagtggaagctacccggcttgttgtggcagatctggaggcagcccccgttctcctggctgcattcgttgacatctgggaacaagcacaggcctgaaggggagcccaagggtgcacagcccctggctacggaggaggctgcaggccaggagtgacctctgggtgccgaggacagacaaggccaggccagagctggccactccttagcaaagccctcccaggccacctgtggggtaggatttgccaaaggggacaggctggcctgctgggctctccactatgggtctccaccaggccctggagctattcttcctccagggtcttcactgacaccacaggtctacactgaaggacggtcagaggtgaaatctccccccggcctttcaatcagtgggtgccactgacaccacaggtctgcactcaaggacggtcagaggtgaaatttcccccccgcctttcaatcagtgggtgccactgacaccacaggtctgcactcaaggacggtcagaggtgaaatttccccccccgcccttcaatcagtgggtgctgaggcatcacttggtgtttcctttccttccagccctgctcccagaaaggagactgcagctcctcccaattctcctggggctccaggatacctcagggctgcagcctccttggggctgtcggagagcagcctgaggatggccgtgccccggagtgggagtgaggagcggggatcagggcagggtcggagatggagggagaccccgcctttgtcttcagcctcacgtacctttgtcgcagagccggcccccccagccagctttacacaggcagaagaagttgcccatgaggtcctggcaggcttgggtccccttcctatcgcaggggttgggcgtgcactggtcaggcaggtctgattggggacacaaagtggaaaatcatgttcagctgccccacccctgcgcgcccaacgcagctgagatcggggcggctgtggggtctcgggtccagcccggaggagctctgaggggcgcaggctgaggcagcccctgggcacccgagccctctgtgctggcctagggctgacagaataggctggcgggccctggggccggctccaggaaaactcagatcaactgggagggagtgccagcaggcctggacgcaaggtgggaagggctgagggcaaaggagcaggaactgcctggcgtgaggcctgggagctcagacctcccagggagtaggcacacagaacccccagctgacctgggggcttccaggcagactcggaacattctgccttccctggccagcccctagcccatctctggtgaactctccctgctgggtgtggcggggaggaccccaggcccaggctgcactgccagaggggtcctccaggaagcccccctctttctgcttagctgccccctctccacgtgtcttgatggctttaggccaggtgtgttctgccctttctcagggtggtcacctgggctcagctcctgcagggccagaggtcaggggaacgggtgagggcctgagggtgggaacccgtgccagtgcagctgcttcccaagcagtcccccatccgagaagctgctcacaaacacattcatacgaggagctgctcacaaacacgcttccaggacacggacccaaaccacgtcccagaggcaggcagggaagcccccgacagtgcagttacgcaagcctgagccccgggaagttggcagaaagaacgacaattacacccggagctcaaagaatcctttcatggctgctggcagagcagaagcagctcggggctgagcatggcagtgctcaggggcgcggtccacactcagctcagccccacatgaggactcagccacgctcagcttagccacacagggctccgtggggaaccctgggtagggcccccctgctggctgagagagggctccggtccattgattccacacaagttcaataaggaccagtccctgggaaaagtgcaggccgggccagcagggccctagggcactgggccagcatcgtcctaaggggtcagccctggtgggggcacgtcgagtcttcagtgcatgggctctcactgccagcgtgtcgcttctgttcctgaggctcccaaggtgacgtttcccaccaggtctgtagaatgtggcgtttccaccagagggtctgggctcggctgtcagtgcaggagccgcttccatccccacctggccggggtcaggggtgcccggtgccagggtgagcggcgggcgggtctgtggttcacaaagctgagttcctccagctcatccagggcttacagtcactgcctgtggccggcacagacacagcccctgtcctcctaggcgggtccaggcaccgcgctcaccagaggccctggctacgagtcccaggcttcttggggaagctgcccaaccacactggcttctttctgcgacgcttcgccgtatgcctcacagcgtttcctccgtatgcctcacagtttgctccgtacacccgcgtttcctccgtatgccccagtttcctccatatgcctcaatttcctccatacgccccacagtttcctccgtatgccccagtttcctccatacgccccggtttcctccatacaccccacagtttcctccatacgccccacagtttcctccatatgcccagtttcctccatacaccccacagtttcctccatatgcctcaatttcctccatacgccccccagtttcttccatacaccccacagtttcctccatatgcccagtttcctccatacaccccacagtttcctccatatgcccagtttcctccatacgccccccagtttcctccatacgccccacagtttcctccatacgccccacagtttcctccatacgccccacagtttcttccatacgccccacagtttcctccatatgcccagtttcctccatacaccccacagtttcctccatatgcctcaatttcctccatacgccccccagtttcttccatacaccccacagtttcctccatacgcctcaattttctctgtacgccccacagtttcctccatatgcctcagtttcctccatacgccccagtttcctccatacgcctcaatttcctttgtacgccccagtttcctccatacgccccagtttcctccatacgccccagtttcctccatacgcctcaatttcctctgtatgcttcagtttcctccatacacctcagtttcctccgtctgcctcacagtttcctctataagcctcagtttcctcagtacaccccacagtttcctccctacacctccgtttgcttgttttgcacaaatgactgacaacagaacacttgtgggtgtggacggagctcgcgtctcgaagtgtttctaagatgctattttcagcaggtcactataaacgctttctactctgaagcacacaggggctggggctggccttcggagttacgaggaaacgaggaccaggaccagggattctgcatcagcacagccgccaggagccggccggggccccatccctgacactgctgtcgcccggctgtacctgggtgctgtgtccgcggggcgtctggagacgtcgatgtggtcatagcagggcctggaacggggaggtctggcctgaactagagaaatgaggggcgtatccgcttctccaccctggcctcagatgaagaggctctgggggcaggagggagtcagacacgtgcagggcaggcggcctgtgcagggcccaaccctccggcaccagaacctgacctcctcagaggcccccaccatggagggatgtctgggggatgctgtgcgctgccgctacgatgtttggttagagattaaagccatttcagaagtggacacctgcccatgtgatgcaaagggctgggaacccggtcttgactttgcctggaatgcctttcggaaagacctctgtccctgaggctgagggacagtgcctgctcctgccaggtgcccagctcttaagcggtccccagactcatgccacctgccccggggcctcccccaactcatttgtttatttccctgttgggaatgtattgatacctctaggatgcaaggacggaaccacacctgaggggtggacagtcagccggtgcccagcaaatatctgtggaatttcctccacacaacagggaaagcgatggagacagaaacctctgcaggcccccgagggcacccacttccctgaccccgtccacctccctgacccccgcccacctccctgatccccatcccgcaagctgggcctagggtatcggtggcctggctggtcatgccctgggcgccagcgcctgttcaggaggtgaagggtttatctcagcttggcccatgactgcgttgaaggacaggagggagcggctgtggctgtggctggaatctgaagccggtgcgggcggccagggcctttccctgggtggtgacgagcgaggaccagagccctgtctgcccgagggaagggcgaggggacactccccgtggcgggggtgggatcccggtagccggggctcagtgaccgctgcctgggccaccgcctgtggggacctgaccttcctggggaaacccatgggtcaaaggagccgagaaatccaagcaccaagtggccgctatggcaggacgggcgcgttcgcagtggagaagctgggtgtgtccgtgggaaaggaaagaaatggaagcagaggctcttcaggggcacctgggaacgcagcctacactcttcccaggcctcctccctccgtccactgtgccgcctgggtcctgggacagcctgagggccgcaggctcccatgcaaggcccgctgggggcctgcttgtctggggctgaatttggactttatggggctatggctttaatttcacaatgaccgataaccagtgaactgaagccaggacagcaccgtgagcaccaagtcagagaattttcacgagggaaccaatgaacaggaacagagtgtgaggctgccccagctgcatcctccgggaggcgccttcccaagggagtgcaaggctgcctgctgtggccaggccaccaaagcaccttcttcaccgccaggcatcttttgaggcacgcgaacatcagaggccccagccacgtgctctggaggagaagctgagagccccaggccacaggcagggcagcctctgagggccggctcagggagagtggccggagcttctggcctggggcaggtggacccgttagaaactgcatgtgttgcctctggcaccagccacagcaagagattctcttcctatcacacagggaacaaactcaaggatcttgaccttgccctcctctccccagctggccgcacttggggacgctgatgccacaaaggaaataaccaaaacaagataactctattgggcggcgggaacagaaaggaacatgtagcaatcactcctcttcatccatgcaaggaagcgaggcgacgccttgaaaaggacggccttctttgctgcaaatagccagaagtgaactgagcaaaggaagcacgggacgcacaggaagaaaagtgctccaagggacggacaggacggtgccggggttaggaaagcgcaacactgttcagacacagtctccgatatatgaatggcaagcccagttaaaaatatctaaagggcttttttaggtttttaagaatatttttaaggtttagttttattaaaaaataagcaagacaaccagaaaaaagactgaggagggcataggagacccacccgcgtgcatgaggccgagtctaaagctgtggccacggcctgtggaaacccggcagaaaatctcccaaatacccagcatatgaggacggcagcaggtgaggcactggggtgagacagactcaaatgtgtggtgttggggcaggaactgagcctgcagtctagatccccacctcatccatcacgtcaaaagaaattacgggcgggtcacagatgaaaacacctaacagcaggtaactgttttgtaatcttggggagaagcctaaagcccaggaactaagagagtataacaagtgtgaatacagaatttaaaagaagagactggtttagcaatcactaagataaaacacgcgtgacaggatctgcttgtctcctctgagcacgcaggagcctctgccccaaatgcagacattgggccctacgtggcacctggctactgtgcatggttgcaggtcagggcaggccgggccacagggcagggccaccctcccattcccatgtttacactgagcatttcctctgcctgtgtctcttgggctggggtctgtgatacaagtccgggaggccagagacgcccacggacagtgcgtggggcttggggagcgggactgagccacctctgactccttctgctgactgggatccagctccaaagccatgcctgggaagagactcctgcctctcccaggatgactccgtcccgccacgcctctgctctcagcgcccacagggactcaccaagctggactttcatctaaaactagacacacgtgacgccagcggaccacagacccagtgcaaggggagctgtgtgggttgtgctgaaggtatgttaaaattcatacaggacacccaaaacaatcaatcttattgcatgataattttaaaataataaaaaagacttgtggcaagctgaaaaaatttttgataactttactaccaatggctaatgtgcaaactcctacaaattgagaaaaacaggcaaaaaatataaacaacagtttataggaaaagaaatacacagtttttaaacctatgaaggacagctttactcattagtt

SEQ ID NO: 5909 - DNA, 2231 bp, Homo sapiens
cggcggcaggatggcgacggccgtcctgctgagcgtgtcggtgccgcggtgggagcgggtggcccggtatgcagtgtgcgctgccggaatcctgctctccatctacgcctaccatgtggagaggcagaaggagcgggaccccgagcaccgggccctctgcgacctggggccctgggtgaagtgctccgtcgcccttgcctccagcaaattcaacacccaacagcttccttaatagcaaaggtagcaacagcccaggatgatataactggtgatggtacgacttccaacgtcctaatcattggagagctgctgaaacaggcggatctctacatttctgaaggccttcatcccagaataatcactgaaggatttgaagctgtgaaggaaaaggcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacgagagaagtgaattctggctttttttacaagagtgcagaaagagaaaaactcataaaagctgaaagaaaattcattgaagatagagttaaaacaaataatagaactgaaaaggaaagtctgtggtgattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgggacatgcaggacttgtatatgagtatacattgggagaagttcacctttattgagaagtgtaacaaccctcgttctatcacattattgatcaaaggaccaaataagcccacacttagatcaaagatgcagtaagggatggcttgagggctgtcaaaaatgctgttgatgatggctgtgtggttccgggtgctggtgctgtggaagtggcaatggcagaagccctgaataaatataagctcagtgtaaagggcaaggcacagcttggagtccaagcatttgctgatgcgttgctcgttattcccaaggtgagcccgtggtagcagcagaagcaggcattatgggataacgattgtgtaaagaaacagcttcttcattcctgcactgattgccaccaacattctcttggttgatgagatcatgcgagctggaatgtcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaa

SEQ ID NO: 5910 - DNA, 4181 bp, Homo sapiens
cctgggttttgctgtgttacccaggctggtctcgcactctagggctcaagggaactgcccgcctcagcctcccgaagtgctgggattacaggagtgagccccgacgcccagccaggaaacttttaaagttttattttctttattagtatttttaaaacaaaataactcatgttcctgtaatagctaccatttgagtaaggtagaagtgagcgctcgaggcagggagtgtgacgtttggaagcaggtggctgtgcagttggtgacctccgtttttcccacggggttggtctgccaccggctgtgttctcatccccatcctgggcgtctgcctgtcggcgtatgtcacattggcttgttctcatggcgcatagtgccctgccgcctggatgcaccacagtccttcagccagcccccactgtgtgccctctgtgggtgttaactccaggtacttgggctgcagggtagaggaggcagccaggcctgaggctgtgcccatctgtggccttaggagtcacagcagccgcttctgagaggccaacaggtatcagggcacccagagccaccactgtgtccagaacggcatttccacttcactggccaggtctaaagtcctgaggggcctttgctccagggacccagggtacctccctcagcagggcaggaactaggccaggaataccatggggcactgaaggaggagcctccctctatccctgtaaccctccatccctgtacctctccatccctccatccctgcacccctccgtccctgtgcccctctatctctccatccctgcacccctccatccctgtaccccatccctgtacccctccgtcccccatccctgcacccctccatccctgtacccctccatccttccatccctgcaccctccatccctgtacccctccatccctccatccctgtacccctccatccttccatccctgcaccctccatccctgtacccttccatccctccatccctgcatccctctgtccctgcacccctccatccctccatccctgcacccctccttcgttgtacccctccatcctccatctctgcatccctgcacccctccatcctccatccctgtacccttacattctccatccctgcattcctccatcgcagcatccctgcatgcctccgttctctgcatccctccaccccagtatccctgcacctcttcatccctccattcctgcatccctctatttttccatccctccattcctgtatccctgtgccctccatcctccatcccagcatccctccatccctgctccccactctcacttcccttcccttcacagacaggcttttcctgccatcctcagaccccacccagggttacctgatgcctttccagctgcacacggggactgactcacctctctctttctcagtcccaaagtcccgaaagagagcatctgatgtggtcagcttgtgacaaggcgtccaccttctgtccatgacatggaggccaggggaaggtctcactgcccagcaccccaccctgtgctcccaggccttttgaatgttcctcctgctcagcccagtgactgcgggctgtggctcctcctccagcctcccctcgaggtcctggtcttacttaggaggccccgggtgtagatgccttcccacccaccaggcattgccccttttcctggcttcacagactcgggaataaagtttccttctgtttcccctcttgcagaaggagatccggttggcagctaaaccgcgctgggaacaggggcctgagtcctggactagggctctttccccggggctgctgcagatggggaggagcctacacccgcctcccgagtgctaatcagacctgacaggctggagaatggccagtcagcctgaggccaccgcgggacaccacctaggcccagcttctccccccaccagagggcgccagagcccgccaagcctcgtaggagatggcaacagggcctgctgctgccacctagcggccaattccgggaatgaatctcggcacgctcattacccagcgactctgcccatcttgaccctttatgtgaagcagaacagccgcttccgcagtgagctgtcagaaggcgtcgtgcctgtcttgctagtggggaaactgaggctcagagaggcagaagacttgcccaagatcacaccaccgggacccaggattcaagcgcaggcctgcccaggctctctgtggcctcctggctgcgaggaggcagccagggaccaggtgccacccttctgagacacctgagatcccaggcccgagaggatgaaggcgggattacctggagcgtgtctgaatgctggaggaagaagggcagctgggagatgaagctgtcaggatgggccgcatcccatttcctgcctcgtttcagttcaactttccaacagacctccctggctcgtcttgctcttctctaatggacaaacaaacaggctcagagaggtggtgtgacttgcccaaggtcactcagcttggatgctatggaacagggacgtccactgtcccagtctgtttatgggaagccgctctgcaactgtcctgacccaccacatgccccaccgctgtttctcttgccctgaccccttgttccctggaccagggtggcacagctccaggctcttgggcccttcccgagggcaggcacctgtgactgtgtccccaaagacctgagtggctgagggggccccacagagcttggacttcctggaggacaaggaggggtctgccagccacccccaccacgcccgccccagggctcccctggagcttccatgccagccggactcaggtgggtctggaggagcaccgtgcctccaatcagaccttgagatgtgccccctgcccccactgtgccctcccctgcccaggagtctggttgcaaaccctgattaaggggattttatctccaccagagggccagtaggtgggaagtagcttaaacaatgcaggtttataatctcacagttctggaggtcaagagtctgaaatgggcctcatggggctaaaaccaaggtgtctgcagggctgtgttccttctggaggctccagggcaggaaggggaggatccacttctgtgcctttccagcttctagaggctgcctgcgttccttggctcgtggccccttcctccaccttcaagccagcagcggaggcctgagtccttctcatgccatctctctgttctctctcctgcctcctcctccacactgaaggacccctgtgatcacactggcccccccaccggatgacccaggataatccatctccctgtttgaaggtcggctgattagcaaccttcattccatctgcctccttcattccccctggccatgtaatgggattcacagcttctggggattaggacatggacatcttgtggcgggggcataattctgtcgacgacaccaagaaacacttggatgttaaggattcaccgaacactgttcaggctccaggtgctgggagcagcagtgaacaaagccaacagacactgccaccctcaaggagttcacgttcatgggcgagggaacagatgagaaacccggcaatgaaagtaagtagcataattgacttgaaaagtgccggggagaaagagaagatggatggagaatgacacctggccccttctctatttctttatttgtttcactcttgttgcccaggctggagtgcaatggcacaatctcagctcactgcgacctctgcctcccagcttcaagtgattctgctgcctcagcctcccaagtagcttggattacaggcatgcacgcccagctcattttttttttttttttttttagtagagacggggtttacaccatgttggccaggctggtctcaaactcgtgacctcaggtgatccacctgcatcggcctcccaaagtgctgggattacaggcatgagccaccgtgcccagctccccttctctatttctaaggtgacccagattcctttactgctttctggcaaatccacctctggccaggcagtaggccggcaacgcagggcttgaaggccataatggggacgtttgtctaatggtgagaaaggaaacactggaaggtttttgcttccctttttaaaaaattcaggtatggccgggcacggtggctcacacctgtaatcccagcactttgggaggccaaggtaggctgat

SEQ ID NO: 5911 - DNA, 3726 bp, Homo sapiens
atgccaggcattgtcctaaaacaaaagatgaagcacttctccttgctgccaccgtgtgaagaaggacgtgtttgcttccccttccaccatgattgtaagtttcctgaggcctccccagccatgctgaactgtgagtcagttaaacctctttcctttataaattacctggtctcaggtttgtctttattaacagcgtgaaaatggagtaagacactggggatggtagaagatgaggttagagaggtaggcacagccagggaatgacagaatatttttgtagtcagctgagtactttgtattttatcctgatggctatgagaagccacatgcggtggtccaatctatttgacttggtgactaatgggatctggggagaaggtgtaaaggaaccaggtgagatatgatgacagcctcaaccaaagatataattgacaaataaatggcctcatgtgatcccataggtttcactaggcaggagaagaaaatagaataattctcctatcagtaatattattctccaatgactactcggtaccttttttcattatttatgtaaattttattgcccctattcaatcatcaggtccttgaaggaagatcagagagacctgtgtctaattcatgtttgtgctgctcacactttctaacacagatcttgcacatatcaaagatgctataaatatatattgaataaatattaacacagaatttgtggggggtggtggtgccagagtcagtatttaaaccaagagaaagcccttcaactccctcctttgcagagagattactcattctgccatactgcacatccacaagacatttacagcctaccagagacctttaaagaaagtttcataacatccctgctgaccatctttttggagatggtgggtactagagtctatataatttctacaagattctaaagtagactgccagacattagaaaatgatctgaatttatgagtcagtcatccacaagagctacatgtttgtcagtggcagggccaaaatcaacaggaccttcttgccaaagtttcgagatacccactcacctatttattgatatctaagggttcagggtcatcaggattctctaaagtcatccatttgcaaacatgttccaagaccagcagtattttgtatatgaaagctatcttgcaatgtagactagctgaatgaaatgtctgtctttgtcatgaactttcatgttttcatttcagtaatgcaaaccacaacagtgctatgatcaaccctcatcatcagtatagaagaaattatctagtcctaacccatgttcttactggtttaatcatttatttccagctttctgctctttgtttattatttatgtaagatgttgtagctctgtatgctgagttaaaatgtaatcattttattaatattttttaaaaagttaaatttctaaccataaattataggatgattagttaaagacagaaatcagttttaagcaaaataactaagggcatatcctcttcccagcattttttattaaagaagtattttattttaaaatatttctagacttaacagaaaaattgcaaagataatacagagtcccacataccctatacccattctcacttattaacatcttacattaatattgtccatttgtgataagtaatgaaccaatattgatatatagtttttaattaaagtctatcatgtattaagatttccttagtttttaactaacattctttttctgttccaggatcccatcaacataactcattaaatttagtggttgtgtctctttaggcccttgtttgccatgactgttaagacttcccttgctttttatgaccttgacagttttgaggagttctcctgtcatttctcctcacatattttgtagaatgtcccctaattgggaattatatgatggctttctcgtgattaggctggagttatggatttatgagatgaagaccacagaggtaaaatgtcattctcatcatatatcaaggctgcgtactatcaacaagatttatgactgctgatattgaccttaatcacctgcttggggtggtgtttgttagttttctccactgtaaagttactcctctcatcttttatttgtattttatattattgttattatttgtttatttgttattattttagagacagactctcactctgtcacccaggctagagggcagtggtgtgatcatagcttactgcaaccttgaactcctgggttcaagtgatcctcccacctcgacttccacaagcgctaggattacagcccttctcccccactgcacctccccacatttttatattatactctggaaggaagccacaaggcatagcacacaattaagaagcagcgatttatactccactctttgatggcaaaatatctacagaaattatttgaacttcttctgcccgggagatttatctattgtcccccattgatttatttattcaatcatttgtttgtatcattatggtctcatggatatctattttgcactttcaatactattttattttgttgctcaagttgttccagccctggccatggagaatacattcagttggctcctgtgtccctgtaacatagccctgtcattattggatttggttgagcactttcttactttcaggagctacaaaatgctctaggttcgtcttgtatatttcctgctccatcctagagtccatgtctccaaggagcttggttcttttattggagaatgtattagaaaccaagacctggacatgctccttgttgcaaaggtgttattgcttctaggctcagctgacagagaaataacatatatgtgtgtaaattaacccatgtctatacacatatatctacaaatccttctctttgtaactatctgtatctatattaagctaaatatgagttgatactgatgtctccaatcccaacccagtagcacatagataattctaaccttctcccccttgcttgtttcctctccctcctacaatgaagaacctggcttctgccatcagccattcgtttatttcattgttcaattccagtctcctgtagagtacttccataattgttaagccatacccacatagaaataactttataagtttgagtgcttatacagagctctttttgcctttaatcttacagactcgattcatttccaaacttacttacgtaagcattttctctcacatccccttcagtacgcttatttcatgcatttgtaatacagttagattattttgccatattttacatttcatcctggaatcctccaaccttctaaatattttttaaattttgtataattaagtttctctatgccatgaagttctatgggctttgacaagtgcatagtgtcatgtatctagtattatcacaatatcataaaaagatagttttaccaccctttaaaaaatccctagtggttgacctattcaattcctttcaccaagagtttctgaaaccactggtctatttgccatctccataagagttttgccttttccaggatattacttaaatggaattataccttatgtagccttttaagactggcttttttcacttagcaacatgcatttaagattcatctatgtcttcctgtggtttgacagctcattccattgtgtggatgtgccacagtttatttagccattcacctactaaagtttacttctagtttttggtagttgtaaataaaactgctataaaattct

SEQ ID NO: 5912 - DNA, 23105 bp, Homo sapiens
agaggctgtcggactctgactgcgcggagaccgctggactctggtcgcggccttagtccgctgatcctcgcttgggtgcccgcccttagcggcccggcgttgaattccgggaagtgggagcttcaggctcgctccgtgcggaggcggggttttgtcatgttgctaggttggtgttgaactcctgagctcgagcgatccacctgccactgccttccaaagtgctggaattacaggcgtgagccacggcgcccggtggccgaggttaataataattaaaagtttctaatcccattgttcagttatttgatttggtgtaaaggcgcactttccaagtcagatgagtttgtggtaacatacattccccaaataattatttttcccttgtgggaaatattccagttttaggctaccagctgtttaaacagtttggttcaaatccttcaaaaaaatctcaaaacataactccacatatgtatttactacatattgaagggtgtattcacttggagaagtaggagaaagcaaacagatgccaatggcctttttgaaaacatgtatctatcagcaataattgaatagcaaaacgaagtggaacactaccatcctttgcaatattagatagttttaatactgggttgtgaggaatgaaaagatcatacaaatcgtcatttctgaagtcatttctgaagtcgtcatttctgaactgagtgctaatttttcatattaagctttatgttaatatccttaatgagaggaacttcctgtgcccgtaatttctccagagaaactattaacatacacagaatgttgtaatcagaagtatagttcagttaataaagtcctcaattacaactctgacattttgtcattgtcttatgaaaagaattactgtatatacagtctattttacgttttccggaagcacgtcaggcaggttttttgtttttttactactaattgtgccattgaatatgctattctgtcgtattgtgccatcaaacatgctattcgaaaaaagatcttgcccaatttgtaataaaatattgaacattggagatttagatttcgagtaaaatcatactttattgctttgcagaagtacacagtaggtggaaaattgcaacaatcttgccagttcattttttaaaaagcgtgtaggtaatccaaagatacctttttgatgatttgttatcaacatagttaaatttgcagtgtcactttatttgaataaactagctttatctctacttagtggtactaaaacaatagccaaacagttgataatctcaacacatgactaacgaaaaattccacataattaacattaaccaggaggtttttgttactatttaatttctcatttttaaaatttcatattctttggaaagaatattacttttccggaatctaagacagcattttgtgggtccttaattgtgatatgctttactaggtaaagtactaaatgggtatccttaggtggggataggctgggaaccacatatccagaattgtgaaatatataacataaacaggataacttgctcctttgttagctttttggatgccagggttaagattttaattccataattatgtccttgttgcctggaggatttgcatatgagaaaccacaaaaacaatcgggacattattaaaataccctagaatctcaacctgtgacagtatttcccatgtccttgcaaaaccagaggaagtctttccaatatgattcttaaatttacaaagtcctctgaatagaaaccatgaaatcctaagtcatcttctagtgaagatttgctgtacattttctgttttcctaataagaaattagaggagtttagttcccagtgttgggcaagggataggactcagtcacctggaaagttcttttgtaactacacgtgcctgacactcctattcttcccctctgctgatatgcagaatttctaggttctaggtagtatttgggaagtttcccagattattctgatatctaccagcggctcatccaccttctttatggtcactgtatttggggattttgaatgataaattcttgaatcactaaaagctaaatttcaaacagaaaattgttagagatgatactaagaggcaagtatgtataaaatctaataggcattgaagaagatacaaagattccatcctctactgaaaaattaagtgtgcacgcagagtaagaaagaaggttaagtagccaacctcaaaaatatttaaaaattattgcattgatgctgtatcactcatttccttgcccagattctttttttttttttttttttttgagacagagtctcactttgtcacccaggctggagtgcagtggtgctatctcatttcactgcaatctccgctttctgggttcaagtgattctcatgcctcagccttccaagtagctgggactacaggcacgcgccaccacacccagctaattttgtgtacttttagtagagactgggtttcaccatgttggcaaggctggtgtcaaactcctgacctcaggtgatctgcctgcttcagcctcccaaagtgctgggattacaggtgtgagccaccatgcccagcccttgcccagattctttattcactgctgtccaaatactgttggtcctctgtacctgcagggatttgcaggtacagaggctcaactataagggacttgagcatccccaggttttggtaaatgggggtcctggaactaattctctgcagatactgagggacaaacggtaccactcattttaatgcagaaattttgtattcatcctttctttttaactcccactaccgggcttagtttaggcctctattttctctatctttcccttcagcttatcctttaggtttccttcaaacttgaaatctaactaaatcagtcccctgttatataccacatatatttgtaaactaaacatatatgaagatgtatgtacatatcatatattcctagtattttagttacttaattttttcacagactaatctcagtattgcctctcatcattcctaatggacacttggtactctagacacttcttcaggtcactggaaaggtatctctcattgtaagtggatataacccatttatcttatgggtcagtctttcataagttcgtttaagtaaatgctcaagaactgttgagtaccttgacacaattgtgctgacaacctataagacttgtcagaaaactctctgacctcccttttaggacatggaattgagtattctgtaagtgcggcatgtcattgtatcacaatatagcatttgtttccatactacattgtgaggtccttgagcaaagagtactgtgccccagtgcattgtattgatattcattcaatacaaatgtaagaatgtattacataccagacattctgctgagggtagggagggattataatacagcaaaaactaacactttcaaagttaaagcctagttcaggacacagtcacactataaaatgacaacttagaaaaatagtatgaagagacatacggtgctgtgagaatccataataaagaaccctagtcagaaaagtctcaaggaagtgacgtgatcgttgtggtctagagctgaagaattaatatgaattaggtaggcaagaaagggaagtacaagagctgctttctgggtaaaagaaacaacatgggcaaagattctggggtcagagagatcacgtcagtgcacttgccagtttgccaagaacaggccgtattcactttcagaagtgttcaggtttggatagtaaattgcagggccatcctatctataagggactctaagaagcatggttctgctggagcaaacagcagctggacaagatgaggctacatagacactaggcccaaaggctaagtgaagtatgtttttcaagacaatgaggaagctattgaaggatttgaaactgggtggtagcttgatgggactggcaaattgaaagtttttactttaggtataaatcccaaagaaggattagatgtgggttgaagtagatacagtattcctaattaagtcaggagtctttggcagataagagaggttagaaatgacatgatagactaggatagtgtaatggaggtggagagaagtagaattgggaagggtaacaaaacttgatgggattggattcaggcagggttaggaggaggagggatgttagtcatttgcagctgaatgacattcacttatatagtaatgtatttggagatgtatagatagggagatcattacgtttggtttaagacagaattgggccgggtgtgatggctcatcccagcactttgggaggccaaagcgggtggatcacaaggtcaggagatcgagaccatcctggccaacacgttgaaaccctatctctactaaaaattaaaaattaaaaaattagccgggcatggtggcatgcacctgtagtcccagctatttgggaggctgaggcaggagaatggattgaacctgggaggcggaggttgcagtgagccgagatcgtgacactgccttccagcctgagcgacagagctagactctgtcttgggaaaaaaaaaaaaaaaaaaaaagacttacagaatttctgatgcctttgaattgcccaggaggtttctggatagaaccatggagctaagtgaagtctagactgaaaattaaagctgttaagtgtgaagtgtgtagggaaaaattaaagtcttgagtattcatgaagtaaacttggaagacagcctaagtgtgtgcagtgaagaattccagtttatttttgactaggtagaggaagatgaactggataaggaggagttacacagttaccagcagggtgttgcgctactgaagatgagtaaggcttcatggaaagagtggtgaataatgtccagttgctgtataagaattaggtggaaggattagcacatattaatcatctaaaaaacaaatacattaatatcttcaaagtctgatttgggagaatttgttttcattgttttttttcaaacaggaactgaacaataccatcatttacagttacgggctatgggtggtcacttaattggtgtgatttgagactgagaacctcctgttccacaaatctatacttcatcctctactaatgcttgaaaagtcattgatagaaatctgttttaaagcatatattcctgggaagagtaatatgtttagaagatacataattctcagctgtgccaaaatttagaattaactgaggagttgtgtactaaaaatgctcaagattatattccatggttctgaggtggggccttggcacatgcatttttttaaaagctcccctaggtgattctaatgtgccattgttgaaaaatcattgacagcatcctattaacacagtattgactcataacgttttgtttagatgacatgtgggtaggacaggacacctatttataaaacagtggttggtaatggccattgagtagggaggatttcgcccaaaagagaacatttgccaaaatctggaaacatttttgtggtcatcccagtgggtgggttttgcggagttggcactattcatacatagtagttagaggccaggatactgttaaaaatcctgcagtgtactgcacagccccctctcctctcataagaaagaattatctggctcaaaatgacaagagtgcccttgttgaaaaaacttgctgtaagcgatggcaagctaggtagtattttccagtgaaatcttacacagattggagttgtggtttggtaagggtgctaatgaatgaggatctactctctacctaacagcttagccaaaactcaccctttcttataaccagtaacaaaggagcctcaaataaaatacatttttcagaacaaagaaatgtgactagcataatagactgattgcaatgttatttttcttgttaacaatttacagtgtaacaaactgttattgctggtaagggtgcaaattggttacaaccactttggaaaactgatgtgcagtattcattatagctgaacttatcctaccctgtaattcagcagtttcattcctgagtgtatacgcaagagaaattaatgtatgtggctactaaaagtttcgtgtaacaatgttcatagcagtttgattcattatagccccaaactggaacaaagtgaagcatattcataaaatggaatattatctggtaataaaaaagaaaatgctacacacagtaacatagacaaatctcgcagtcattgcattgagtgaaataaacacaaaataattcatattgtataattccatttatatgaaattcaggaacaagcgaaactaatcgatgatagaagtcaggatgatattgacctttctggggttggtattggcttggaaggggcacagtgaaccttctgaagtgatggaaatgtataccttgatctggaatgttatactggtgtatgcgtatgagaaagttcatcaagccgcacattgactttttgtgaactttatatgtgttatactccagtgttttttaattactaaatataagaaaaacagcaaagccacttcttaactacttgaagtcttctgtctcaagcttggttaaatacagggtcaactacatactatattctcaataaatataaataactctaatgcattatttggtaaaaggaatatgggatttggaatcagacctagtttgtttgttttttaagactagtcaagtgcaggagtgagaaggagggaaagagtagaacaagagttcaatctagacctgactgaacaaccaattgagataactcactacctttggaccagcttcagacctagttttgtatcacagcttcatctttcattagctgtatgacattgaataagtcacttacttgggtactttttgtgactataaaagaacagaagatagctgagagaagtataaaaaacatttttaaaattttagccttcattcatgatccctcaccactgagaaacgtccacacacattcaggaatgggcctcagcagttaagaatgcattaggtgacctaacacctctggctttagctagttgaacaacagaaccctatctgaatgaatcagatttttctgagaatttaaaattaggattgagagaagcttgtcagactgctgatcacttgaactgggaaaatataaccttaggccagggctgctttgtttggtagcaagcagcatgtggagaatctgagagctgtgatacagaacaagagtaatctcagattacttactgtgtcacccagtgttctaagtgctataagtctgtgaatttgggtacaggtttagtattccttatccaaaatggttgggaccagaagtgtttaggatttgggttattggaatattcgcgtatatataattagatatttggggatgagtactcaagtctaaacatgaaattcttttatgctttatattttatgctttatatataccttatacacatagcctgaaggcagttttatacaatgttttcagtaattttgtgcatgaaacacgtgatgcatcatacaaggtcaggtgtggaattttccacctgctgtgtcatgtgggtgctcagaaagtttcatgaggcagaaagattgcttgaatctaggagttcaagacctgcctgggcaacatagtgaaaccccagctgtatttaaaacataataataaaaagtttcagattttggagcaaatcagctttttaattaggggtgctcaacctgtactattatccttacattacaggtaaggaaactaaaaagcttgcttaaagtaagtgctaaagatagtaaaacccaagtaatttgaccccggagtctgctttcatgaagcagtgctgacataccagacagagatactgtagctgcctcagttcctgatagctttctggttcctgatcttagcgctttgcaaggataggtctgctccctatctttgaattatttataataatttatccttaaaataaaattttgtgtcttaatctagcttgagtgggtttcagccagttgcaactgaaagagccctgcctcagtttgactgtgaatggggttgcaaataacaaacctcacagaaactgacaatggctgattcaaggtgagataggtgggtaatgtggactttccaccattaagatggaaacttagtttgtgttatgcagcagtgaatccttttatccagactttctccaacagtgttttagaactcagtcattgagtgttgcattacagaatttggtagccaaatatttttaaatgtcaagtatattggttactatatatgagttttgaaaagcacattggaaaagagaggcattctaaacaagttttccagaaacaaagcagattggagcaaactctgcaaatttgacaattattggaagccatttctgcctgtagcctatggtctgagaatgtttgaccagatcaaattattcgagaggcgtgtttaattgcagcatttttttgccacattttttctaatactagagtttttacactgagtaccagaaagtgaaatcttagtattaggaataagactcaaggaggtgcaagtgataataaagaactctaattcctcagcttcctccccaaatattttctactgcctaccccttttcatgcctcacagaaatatgatgatacttcacaccatctatcaatagcaactaggattggaatgcactgtgtgtatagggatatgactaaagggcaagctggcatgcctgcttattctcttgtttgcttgtgaggctaaaacagaacaatgtcgatggacagagtcccagctgttgctaagaaacagaagttcagaagaattgacaacttaaggagaaagctgacccactaaggtcttcagcattaactaaatacaaaaggaatctcccctaaaagaaaatcggcaagcaatccttcacagtagagcagttgcatgccataaaaccccaatgtctgcagtagacccagaccacagactatctcaacttctcaggcacctcccattctccaattcaaaggaatttgcacctgccataagtgagtacccttacccaaatgaggaacctcagtgtctttcacttgggaatgtacctgaaggactctataaaagggaatccaaactgggtgtagccagattttctaataactggttaggaagtggttcaattaatttatgccttgtaagattacaagggcctattatgtcctatcatactcctgctgcatacagtatatactgtaattgagctagttaaatttgtattgagtccacagattgcagtataaattcaaatatttcttgaaagctctctctatccctgtcctcaggccaagtactaggaaaacagtgtgaaggacagggtttttctcacttggagttgacattctagtttgaaattggaggaggagaaagacagatgaataagtaaataacaggattctaaatggaagctgggtgccgtggtacatgcctgtagtcccagctacgtgagaggctgaggcgggaggattgcttgagtctacgacctttagtggaggcccacctaggcatcatagcaagtccttctatctttataaataaataagatattgggatgatttctgtaaaggaaagatagggtactatcagaaagagtaacgagacatttacatgggaagagcagttagggtggtcagagaaggcttctttgagctgtatctggaaggatgagatggagctgattgtaggaagaaccgtgggaaaagtaggaaggagagcaaatgcaaagaccttaaggtaggagagcgttgtgacatggaaaggactggaagaggcagatactgctgaagataagtaagtaagaaatagagttgataatagagtgagcactcattcaacaatttaaaaaattattttttaatttttatctgaattcatttttacaaattttgtattaacattaatttgaggaagtaaaaatattcatttggctagaaacttctctctttcttttcattttttaagttctctatacatcttaattttttaactgcctgaaattagacttggtataacaggtataaggcatgaatattttacttttaagaaatgatttttcaatcaatttgattttatcatttcttaacatttgttattatgaatcatgtttctgttttttcctctgcttagttaatatcactttagagaaatgtaagtaaaaactgtgcaaaactgttgtttcatatactgccattaacaaagctcccaaggagacagtatatggacctacctaactcatcaaaaataattagcctagacaaatagacatattggatgggaagggaaaagaagtacaattagctctccatgttgttgtcctatgggttttcacagttaaatcaacatgcagttttcaatgacaatacattaataaaataagctaattagacattttgaaaagggttcaaacttaagaaaaaaactctgtatagccccaaatctacagtaaaatagaactgctgcaaggaagagaatggtggtaggacttccgcctgtttttcatacttccatttctgttctgtgccttccccctgcctgccactctcatatagaaatcagagagagagaggtctttaaaaatgtaaaacaaatcatgttgctttgcactctttcagaaaaattcaacctcctttctattgagtcttacaagagcctgcatgatctcacttcagtctaactctccaaaatcccatcccctatcattctcccctctactcattatgttccagccaattggcttgctttctgtcctcaagcctgccaaattcttttccacttgcaggcttttgctctggtcatttctgttcctggaatgcttccttggctcttcacacatagggctatttgtcatcttttaggtctgaggccagatgtcacttccttagagaggcctccaaaacattttccaaagagggcttcctctgttacttttctaattaccctgtgtatttccttcgtagtaatgatcgtgatttgcaattactttattttacctgtcttgtctgttgtcttctctgttactaatacataagctccctgataaactgatatgatgaaacatttggaaaacttaaggatgtattaaaagtaaattttgtaggatttttaagaagcagcaattaaaaattaccagtgaagcataacaattatacagaaaggaaacaaaatcatcgtgccctattaccatctattgtcaacgtgaagtaaatattgttattgattttaaaaaatatggtgatagacagtagttctattggagtggtaggggtggatgtagcatgtgagtgctaaatgcccatagtggaagttggcattgttgatccaacctccatctgtctttctcccataggatagtggccacatggtccagctttagagttcagcctgattcacttaaattgattagtataatcccatcctgcttgccactctactacatttatggatgggcagatctaagccaataaattcatggcattccctaggccatagggcatagttaaggaatgggcatataacccaatttggaataaagagttgtgagaggtttgtttaggaattcagagaggaggcttttttttttttttttaaatgaaagatgacaatgagcttcttttttgcctctgggtgttgggtgtgttgttgtgaaaccaggaactgttacatttcttttgcttccacgagagacgcaatcgatgtaaagatgaagacatcacacagaagagaagagaactgagggaactacagagaaatggagctagagctgctgggtgaagctgactctgaggcttctcataaactctgtgcttccagttgtgaaaataaatgcagttctcatttcttcttcttcttttttttgtaaatttttcaaaattttatttatttagagacgggagtcttcctatattgcccaggctgtttttgaaaacctgggctcaagtgatccttccctcccaagtagctgggactacaggcacatgcccctgtgctcggctgtagttctcattttttaaactaggtgggattgtgattactacaagttgaggcatcctaactgataaaatcctattaataagaagtcaagagataaggtctaaaatatataaatgaagaagtagctaggaatatatattatttagaaaaatggaacttgctagcagaataaacagctttcagtagctaaaaagtgtttgtctctttaaaatagaaaacagagatggggaggagagatgaggcacaggctattttttttttaattgtgagcctttcaacactttgatttgttaattgcatattttaattgttaagttttttaacctgatgaagcttagacttttaaattgagcccattttaaaaattgtatcttaaattgctattttaatgcaagcaattttaaataaaaatatttggtgttccagatatagagaatgggtaatagaggagtagggtacatggagtaggcctagaaggaaagtcaggatcttaaaggttacgaagtttgaagttttggggtttttttaagtgcctaatggctaatatttttaatgtatgtaccatgctaaaagtactgcaaaagtgttgaaaaacaacaaaaacactgatagatttgttaagatagatttcttaaaacaaattgaacattttatacataatttatcaaagcccattttggagagagaagaatatcagtttttctttttcttaggttgatattggcagtatgttttcccaaagtaatattatagccctatgttccacttgtaaaatactcaactgtttctatgtgtaacaaatttattacttcccaatagattttcacagtgttctcatattcactgcataaaattccagataggtatttgatacttaacttctttctcttactacagatccactttgcatcttatctcacccaaaattcagctggcatctgacatgtattttagtggaatgtttcaatatctttacaacctcttaatttttatacaggatatatagttggagacgcattgagcaatttgttttgctacacaaaaatgttcatgggaggggaaagttgtgaaatccagcctggtgtccattcaccatatagtctggaatttgctgccaagaagaaagggcacattttgtaactgacacaaagtttctatatgtgtaagtggtgaccaaggttagagagagcagtaaaaacagcaatagatcgtacagtacataataaattttagctaagatttttgaagcacgcactgagtgttaggtagtgagatcacagtgatgatgaattcactgggccaatgacgagtggggtgaccataggccagtttgcagggtactaccccagtttgcatctgctttcccattgttttatctcattagtgtcccctttctcacgtgtgtcacagtttggacagtaagttatctaatcacccaaaaaaagggaaaattcatcccagactgagtggaagagacatgggtacgtgaaaaagcatgatctcctctgatttggcttgaaaaaaaagttggcagcagaaaatggcacaaggtagaaattaagactgaaaagatggtgaggatccgagatggtatagggccttatgcactagttttaaagagatttctcttgaaggcaatggggactaatagtggtttggggcaggcatatgataaaatcatatctgtttagagttgaaaagagcaaaaatttcactatattaccctctatcccttcccacaaatccccccgcaacaccccccacacaaagctgggagaaaggggaaaatcatattctttctgagtgtaaatgcactcataactgagccccacttaactccttggaatgaatgccagaccctatgtattctatctgtaaaactgttgtcatcggcatgatgaatctacgtgtttgcagatggtaagctactctaatacaatatgcattacttttcctataagttgaattgtatgttttaagagattattgtgtctgttggtaagcctgttaatgctagttgcacattattgctattatgtaattgaaaaaattatggaaattgatgaactaagaaggcaactgtttctatgaaaattttgttgcatgcttttgaaaaactgaaagacaagtgtcttagttcaggctgatataacaaattactgtagattggatggtctataaatgacagaaatttgtttcacacagttctggtggctggaagtctaagatagtgttaacatattcaggttctggtgagtgccctcttctgggctgcagactgcctacttgtgggactctcacatggcagacagcagaaagaagcaagccctcttgggtactaatccctcatgggattagtgtcccctcaagaccacacctaatcctaattatctaccaaaggccgcacttgctaatattacattagggggtaggattgagttttgggaggatgcacacattcagtccatagcaacaagttgctaaaaatattgggataattgaggtatggatggaacaactctaaaaaataaataaaattaaaggagtgggcagcgtaactgtcaagaaggttatgtgctcattttgctataccacatgctgtgtacctgtggccatactatgctctactaaagatatagttctggcagctacaatcagggctactacttggactagcagtagcctgtggtccttgtctaggatttatctagtttttgtggggggcagacaggtgaattaaatgaaaatatgatagggatcagcatcaaggcatcctggaagtctttaagagttggcactaatcttctccatccccacctgaaatgtgagatactgcttttggtttactcttttgtctgaagtttccaagactctacttagctttccccactataataggtcttacttcaggatctaaaactcaatgtagaaattactctaactgccaagcatgtctatgccttcctaactataatagctcttaacttcaggacctaaaactcaatgtagagattactctaactgccaggcatgtctataccaaatataacattcagggactggggaccatcagctgttcccatggacccagggtacacatcataagccaggatttggccaagactaaagtttattattagtttggtgcaaaagtaattgcagtttttgacattaaaagtaaaaatgtcaaaaactgcaattacttttgcacaaacctaatacctggctcctatatgctgctgctctagtaaggccaagatgatactgttggtctgcaggtattaatgtcaactcagaccctgtgtctgtcttctctgaagtatctaaatattccccactttccagtgtgcagtcacctgagaaaaggcctagatccctttaggaaaggatgggaagaatcattacagtatatgattatgggttccttccctccagggatctggccacctgtcaacaggttcccagtctgaaaattggctcagatctggcaattgagtgagggatcatgatgctttttattgtgataaccactcttagtctccccatccactcttgctttttttgattatatatgtgaggcggtactcttgttgcctccccatctgttttgcacatagggacactgaactctgttagccaactctaaaacttgttttgggttgaacccccttgactgtcactctgattttgctggtcatgataattgtgactccccctgacttctggcaataaaccctgccccctggcatttaatgtgcttctggggcccatcattcccattccttttgataagccaagttctgtgatagtatcttctaccgttacctctgactatcaaaggtgaactggcactgaactttttagtgaggctagtgcctctcttactagtacattcctgatggccttagtgaatggtgtgtcctccaggccctcccatggaacatcattcttgtgtgggctgctggcctcacataatgtatctactccagcctacccatttccctgacccctttaaatcttgttcttcactgtctgcctttagcagttgaggcatttcgacttcactcaacatgggcaattgcttctagtaaccatcctaaccggaagtttgcaccctcctcagggaccccgatagagtattaaatctcatatcctcaaattgcctccaacttaatgatgtcacttttttccagtcttatgtttcagccttcttgatcaaacaccctcaacatccagtcccacatactcctctatttcctaccaatatattctgactaattcttgcagcttcttttgggggtatacattaggcctagcacattcccatttgggccatgacttaatcctagatactggtctgacagtcatgagagatagggtaggtttccaagaaggccctctgttgccttattcaggaactatctacttttgagtactagctttcagtaagaaaggtaggcagcctctgcagactgagtattcagaggagatttgacagccaaaatgtttgggggtatccccctagctgtcctcatcctgtatgccagagtcccaagttttccaactaacaacctaaccttggcttcaattgtattttaatcttcttgactgttaagtcctgagtttggtgttccagcttttttctgttttcccaggacaaaaagataagggcctctttgtaagctactaaagaagctgtctggcctacacagtaagttttcacttgtttgttaacaagctctcagattttcattaacgttttgtaggccttaatgtaattttataatagctggccaattccattgttcttgtagatattatcacacacacacactgaatttttgccccaacaagggcattgctctgcatcagaacattctcccaagtcactcctgtaagttgttttttttttttttttgagacggagtcttgctctgtagcccaagctggaatgcagtggcgtgatcccagccccctgcaagctctgcctcccgggttcacgccattctcctgcctcagcctcccgagtagctgggactacaggcgcccgccacaacgcccggctaattttttgtattttcagtagagacagggtttcaccatgttagccaggatggtctcgatctcctgacctcatgatccacccgcctcggcctcccaaagtgctgagattacaggtgtaacccaccgcacccggctactcctgtaagttttaatgactgagccaccacgttcttccaggaactatccatgctccagcaatcacatatcccattaacagtgggacagttctgatctaaccccaagccccatctatccgtttgtttgagtttgtggtataatatgaaataatttggtctttgtctccagttcctgtcacagagctaaaacccttggaatttccttgttattcataatatccctctcttgatcacatctgagtttatgctaatgagataatttagggtggggcccctaaatagcctcaggatcaggccagttgccagaaaaaccaggtgattacaggatgagaggattggaacttttaactacacccaacaacctccaggaaagggagtggggctggatggatgtcaagctctataaaaactcggacaacatgatttgatgaacttccgggttgctgaagatacagagatgttgggaggctagcacacccagagacagcatggccgctctgtgcctgctttcctccccttacctcatcctatctatcttcatctgtctgttcatgtttatcctttataatatccttcataataaaccagcaaatataagttgtttacctgagttcggtgagccaacctagcaaattaattaaatgctggaagaaggttgtgggaaccctgatttgtagcaggtcagagtataggtgacaacctaatacttaaatctgaagtgaaggcaatcttgtggggctgaaccctcaaactgtgggatctgacattatctccaggtaaattgccaggtggattacactagtccaggtagatagtgtcagaattgaattcaattatataatacccatttggtgtccagtggagaattgcttagttttgggaatagccccccacacatctgttcacagaagtgttctgtgtttagtgtgagagtgggattgtgggaaacagaatgtgtttttttttctttttttacagggttgctgtaacaaaataacataaactggttggctaataaataacaaatttatttctcacagttccagaggctggaaagttcaagatcaaagagctggcaaatttagtgtctggtgagggctgacttcgtaatagatggcgtcatctcatgtgccctcacatagctgttttttttttttttttgagatggagttacgctcttgttacctaggctggagtgcaatggcacaatctcgggtcactgcaacctccgcctcccgggttcaagtgattctcctgcctcagcctcccgagtagctgggattataggcatgtgccaccatgcccggctaattttgtatttttagtagagacagggtttctccatgttgctcaggctggtcttgaactcccaacctcaggtaatcagcccgcctcagcctcccaaagtgctgggattacgggcgtgaaccaccatgcccagcaaccctcacatagtttaagggacaaactagctctctgaggcactaatgccaatcatgagggctaattacttcccaaaggccccacccacctcctaatactatcaccttggaggttagtatttgaacatatgaatattggagagacataaacattcagaccactaatccttataccaactggttcactttggatgttccaggaaggagaatataacattaactcaggagtacaagaatactggaaaaatgatggggaaaaaaagacacagactgtggtgtagatctaaaaatcaggctgggttggatggttcatgcctgtaatcccagtattttgggaggccgaggcaggtggatcacttgaggtcaggagttcgataccagtctggccaacatggtgaaaccctgtctctactaaaaaatacaaaaattagccaggtgtggtggctcatgcctgtaatcccagctactcgggagtctgaggcatgagaatcacctgagcctgggagtcagaggttgcagtgagccgagattgtgccactgcatttcagtctgggcaacagagcgagactctaaaacaaataaataagtaaatatctagcaaaatctcagctaacccattgtggaactctggggaaaatatcgcttgttagggaaattcaacattggacagaaatgactagaccctcataccattgccatgttcagtcattggctgagggctgccagagaagacgttgcctcaactggtatgctgtggtagatcttgacagtgctgcagatggaggcagttagcttaatggtattcattgcagctgaatggcaagttctatctaaaagggagatgttagtggtgtacctcctatgactgccccactgatctaacctgagaaggttcaggaggtgcctgcaactagtagtctaagcatttgatgaggaaggagagtaaggccaaaacaaggcaggttggttgaaagctgatgacggagcagttatcccattagatatccccaactcttgtcactaggcaaaggccagttgaaaactggttttatcagtacacatccacacctattcatttacatattgcctatggctcctttttattttttcatttacatattatctatacctcctttttttatttttatttttttctttctgagatagggtcttgttttgtcacccatgctggagtgcggtggtgccatcacggctcactacactcttgaccttctgggctcaaactatcctcctacctcagcttcccgagtagctgggaccacaggcgcacgccaccactcccggctaatttttgtatttttctgtagagatggggttttgccatgttgcccaggatggtcttgaactcctgaggtcaaccaatccacccacctcggcctcccaaattgctgggattagaggcatgagctactgcacccagcctggctcctttttttactatgatgcagtgttgagcaaatgcgaaaatatttactgcttagtcttttccagaaaagcttgctgaaaagtttgctgattctcaatctatgctattggggttatttacatctatgcattgaggttatttgtatctattgtatctccatggtagaattactatataatggtgtgctgctgcttatctcttcccaactgcattcagaggaatcatgttggtagcttgaaattggctgtaatgggggaattttaccacagaagttagcaaatgctacaattcgggactttttctttttggacagctgattgttaaacattgacctgcagcatttttcgctacagggtattacaggctgaattgtttcccctctccagaggtatatgttgaagtgcctacccacagtaccccagaaggtgggtctttaaaaaggcatttaaggctaggcacggtggctcatgcctgtattcccagtactttgggagtccgaagcaggcgaatcacctgaggcaaggagtttgagagtagcctggccaatgtggtgaaaccccatctctactaaaaatacaaaaattagctgtgtgtggtggcatgcgcctgtaatctcagctacttgggaggctgaggtgggaggatcacttgaacctaggaggcagaggttgcagtgagctgagatcacgccactgcactccagcctgggtgacaaagcgagactctgtctcaaaaaaataaaaattaaaaagtcatttaagttaaaatgaggtcattagggtgggctctaatccagtatgactggtgtctttataagaagaggaaatttttacaaacaggtattggggaagaccatgtggtaacacaagaagacagtcatctacaagccaagacagaggcctcagaagagaacaaccctactgataccttgatctcagacttctagcctccagaactatgagaaaataatttctgtcatctcacctgcctattctgtggtactttgctattgtagccttagactgatagagtaagtgacctgagaaagtgtcaaaagttcctgcagaagaaatcgattgaaattacttccaaagagctttggtatagggccaggaatagtggctcatgcctataatttcagcactttgggaggctgcgatgggaggatcacttaatgccagaagttcaagaccagcctgggcaacatagtaagaccctgtctctaatgtcaatttaaaaaacaaatacacacaacaacaacaacaacaacaaacaaaaaatggctttgaatatttactgcatggtcttttccagaaaaatttgcacctcacagaagtttgctaatttctgtggtaaaaattcccccactacagccagtttcaggctaccaacatgatttctctggatgcagttgaggataagcagcagcacaccattatgtagtaatcccaccacagggatacagtagatacaatgcacagatgtaaataaccccaagagcatagatcaagagtcagcaaatatacctgattctttttaccccaactgcattttgatgacatttaataaatttgttgagcactctaggtaccatgcaagccttttggactctgtaaagaccagttcccctaggcaataatcttcaagactctagaattagggttatataaaggcagtacagctttgttccctcccacctgtaccctgccttttgttggcctcattcctaaggtaaagtgatagctaggtaaaaagcagaagatacatacagctaatgacagtctaagggagaatttcaggaaggatccagtaggccaggtgagtgacacctgagctactttgtgtttaagatatactcatgtagaaagcccttgagagctgggtgcagtggctcacgtgtgtaatcacagcactttggaaggctgagacaggcggatcacctgaggtcaggagttcgagaccagcctggccaacatcgtgaaaccccgtctctacaacaaatacaaaaattagctgggtatggtggcaggtgcttgtaatccccgctactccagaggctgaggtaggagaatcatttgaacttgggaggaggcagaggttgcagtgagcggagattgcgccattgcactccagcctgggcaacagagcgagactccatctcaagaaaaaaaaaaagcccttgagagaaaggggcaagtaatatgaatgtaccactccctaggtagtataatctttggccttaaaagttctctgtgacttgacctagggtgtttttaacatggaaaagagcaaacttattgggaaactaaatagtcccaagacttcaggagaataaaataatcccagtgaccttttatgctgttgtggtgtgaatatcgcaccccgaattaatatttgaaatttattagccaatgtggtaatataaaatgtggggctgttcgaaggtgattaaggccataaaaggggttacggaagtggattttctctctcccactcttttgccatgcaaggacacagcatccattcccttttttacctttctgccttctgccatgtgagaaggccctcaccagacatcaaatgccagtgccttgatctcagactttccagccttcagaactgtgaggaataaatttctattttgtataaattacccagtctgtgttattttgttacagcaacacaaatggactaagacatataccattagcacttttggaacatgatttactttactggcacggtacatatataaaataaactcttttatccttttgaaaatcaataaatatgcattgaatgcctatgtgtttatgtaggtgtacacaggctataataggagagctctaagatatttaaacatttattctcacatcattagttacttgatagagagtataaagggcagaaagacttgaagtagtgggagcatagccactgctgattaaagacaaaaaataagaaagtagacaattatttgtcagttaaaag

SEQ ID NO: 5913 - DNA, 1040 bp, Homo sapiens
aagcattcggaaccttgattccacaggacagaagataaaagaatattatcaggcaggtaacacaagaaatacaaattcaaaatcagtgcatacagtgcgcagtcttccaaatgaagagatgaatgttaaaactattcagagaccactggtcattaagttgagcaaaaatcaagacgtattttacagcgtaatattgataggtcttaaaggaaatgttttcagtcatataatatgttgacactgcaaacataagcagagcttttgcggtacagtctggcattaagtattacgagagaaaaacattttgcccagagacacttactggggctctatttgctctggaaactattagagaatgttgtatctatataatagaataatattcattaataagaattatttaaggtttggtttataaacttgggcatacataataatgtcaattaaatggcaatataaaaattgtaaatgttgataactacataaaatttttatgtctgttaaattaatatgatatgaatgacaattatttgaagtttctagctcttttcccttgtgagagttgtcagaatcaaaatgaagtcacttgtattaaattctaacaaaaaataaataaagccaggaggttaagaagggagctctcacacacgtctatcgtaagaactgctacaaagcatctctgaagggctcttctgcacatatgcctgtaataagaacttttgccagcagtccctgcatctctacatccatggagccccattgacattccccacctgcagcggccactgcagctcaaactgcagcttgctacgtgagtcacaaggatagctagctggatgcataagaacatttgactgacacagtctcccctgtatccaatgttctctttgttttcaaacaaattccttatgcttttcccttttgcctttaaaagcttctcctggcttcaacctgtttggatatgcctgtggtccctatagccctcatatgctggatttgcaaatcccctgcacactccagaataaactcagttcaataaa

SEQ ID NO: 5914 - DNA, 805 bp, Homo sapiens
ggaagggaggaagcgtagaaggtgccgatgcacttttcctctctccagccctcctgactgctccaagaatttcatcgaacaagactcaaagaggcccagctgctctgcgttttgattcttctccctctctcagtccacactgacctgggaggggcttctcaaacaccacatttcctagcgtgctgtgagaagaggactgtgagctaagaagggagaaaagagagtctaagtgccattcatataggccccccaatttgttacccttagcatcagaaaatgaaatcagtaaacaccaaatgaaagcaacaacaaaaaaattaacttcaggatctaaagttcacatttaaaacagcttcaaaagtaacatgcacaactggcaacgatctcttcagactactaatgtccagatctgacaattaatatgctaaaggtggccagtatgcaagtggtaacagaaaacagaagggaaaaccgaagaaagttcatgaattctctacctctgagcaagagttagctagctgagtatgttaccgaatctcactttgaggactaggagtgggaatccagatttaattcctagttagtcattaactatatgaacttacttagatttaacttctttgggcctcagtttacctctaaaatgagtacaattgtcaatgaaattcacaaacatttaccatgtgggtaaaacaaaaagcatagcccttgctccaaattctgacacgtctaaattctatgactgttttggctatgactttctcactcttagaataactgggtttattaggaattacaattagtt

SEQ ID NO: 5915 - DNA, 27119 bp, Homo sapiens
agttaaatgttttatagacaaaaccactaaaaccagtgcattcattatcagcatattcattatcgtcatcctcttcatcttcctcctcatcctcttcctcatcctcttcatctttctcattcttccttttcttgcttttttcagccttgacatctccctttttcgctgcatcaggctttcctttagctcgatatacagcagtatcctttctgtatttttccttcagctttgcagccttcttttcataaggccatttgtcatctgcagcactgttagtccgcatctctcccagtttctttgcaacatcaccagtagattaaaatgaaatcacttttttaaaaaaagattgtatctctaaataaccaccagagaatggtttttctgcttgttgttacctcatttttcacagatcttcctaataattatcagtggtacaaatgtgggaaaagttcatccagggctaagggttcgtcacctgccagtagtgggatagataagccacgtggctcaataaattattgaacccatagtgtcaccctccaagtatttttcttttttaatcacaataccataatgcctttaggtgtgaaactgggtatagcctaagaataggaactggatgagatatttcatgaggacacttgatccttgcttgctgtgatattgctaagggtgtggcatcatgatttggacaaaatgagaatggcaggaattggggagataaaatatcaggctcataggccttcatggagttaaagcagtattgtgtgtgcttagctccagaattctcagaatttttacaataattcaacaggacgttggattgaataagcactttaatactgaaacactggatttgaaaactggatgttatgtgttctactcataagcctattactcattggctgtgacctgggatacatcactgcttttgcttttagagaatgagggtcattgggctaggtatttacagctcttaatattttagggttgcagtctagcaccgtatttttaaaacaagaattctaagcttctaatatccacctgttctttgcaaggttaacttttttttaacaaactctgagaatcagaagtcttagacatttacttgataattttagcatttgaggaattggctgatgttcctagaatcaaattctgacagaaactttaatgccccctctatctcactgttttatttaacaagagttctgattgctttcattggttggtaaaacagatatttcaagtaatagccacactgattaatttcattatggtgacatttcattaatgtcattatggtgacatttcagttttatgtatgtctatactgcccacacacaaaagtactaccgtgtgattcaatattttcttctgtagttcatttgtataaaaaatcagatgggctgggtgcggtggctcacgcctgtaatcccagcattttgggaggccaagacgggtggatcataaggtcagaagtttgagaccaacctggccaatatggtgaaactctgtctctactaaaaatacaaaagttagccaggcgtggtggcgcgcatgtgtagtcccagccacttgggaggctgaggcagaagagtcgcttgaacccaggatgtggaggttgcagtgagccgagatcatgccactgcactccagcctgggtacagagcaagatgccatctcagaaaaaaaaaaaaagtctgatgtgatccacagaagtggtttcatgacttaactgtaggtctgtctcaaccttctttggacagggtgaggaatcaactagataacgttttaaatttggtactttaacatttgctgggcacttagatatactactacacttatgtgtaatagcttagacgttagatacaaattaatcattacctgaaaaattcctaacagcagtgggttgagtgggaaaaaaggcatggaggatgaaatcatgttctttttttttttttctttttgttggcgtgtttgataggtttaatatgttactgagtctgccagttcaaatagcccacttagggatcttagggatttgtatttatttacatttagggttacctcaaatcctatggcaagcaaaaaaataaaaataaatccccaattatttccctcaaatcaaaccagaattcctactgtttctcaaaaaatcttagtttcttagtctatatatgcaatcataaagcttcttccagtgtttgtataattttggtggcctagatcttggtcagatgggacagggaggggaatttttgtatgaaggaacataaccaaaaaaaaaaaaaaaaaagcaccaccttcttgtttcttattcctctgtgtatcatgtgatactgcttttaaggccttagaattgccgaggccatggtaacccaaggcagacttgctgttttcctctcagatttgaagttctgcattttattagtcacgaagaactagtctgttaccagtaaatacttaagacacaaaacttgcttctctgtgctgctgtgtacttcctgttttgtcagatttccatttagggaaaagaatggattttatgctaggctagcttctcctgaaattcagtttggaagccgtccagatatctagggcgggtggtgggggagaatggcatgtcttgtctatatatgatgtcatttgtcagaaagattcatttggctgcttatcatgaaagagagggttgccaggaaggaagagaaaccttttgctgtcagaactatttagtgtatgacttgcctactttgtggcttgcctttaggctttccatgtcaaatgtgtttgaggttgtgaatgaattattatattgcctatgaaggaaggatctatgttcatttctagtaggtttttattccagaaatatgtaagaactgtatttagacacatttgcttcacttatagaagagacaggtcaaaggttagatggtaattagaactgggctacattttaaatgttgaaaatgttttggggggaagttgcagtaaaaccattttaaaaatcttttgcagctaaaatagtaaatagaacacctagttataaatgatgaattttctgtcagtttttatcctatgaaatgaaattccaattagttgttaatagaatgtgtgagtagaatatgctttcagtgtaatcctgaatcctactaatactgctggtaacggaatattgttttgcaatggtggaaccaaagctcgtctataaaattctctttgaccaaattgacctggtctgcattaagtcagagctaattttctcttttttgacctgtcagtaaaatatgaaagatgcttttcaatccctgaccattagtgaacagttacagaatttcttctttattggcaccctggctcttcgttcactcacatgttggaaatgttctcttaacatctgtatgttgtcttccttgggagctgatgttgaattctaaaatatttggaaccatccctataaattttctgccagattcttccctccccttccccccaccccccactctttttttcatctaggtgtatgtatgctgctatttccgagacatacattccttacacaatcatgaaaaaaagttttcctagacacccatcatcccttactgcttcatcccccattttgctttctaaatgtcatctcttccttttttttttttgagttggagtcttgctctgttgcacaggctggagtgcagtggcgtggtctcggctcactgcatcctccgcttcccaggttcaagtgattctcctgcctcagcctcctgagtagctgggattacaggcgcctgccatcacgcctggctaatttttatatttttagtagagacggggtttcatcatgttggccaggctggtcttgaactcctgacctcaggtgaccaacccatcttggccttccaaagtgctgggattacaggcgtgagccatcacaccctgccctaagtgtcatcactttaaaagtaaccttttctcttaccctattctccttttagtaacctgtttccaaatcagtgattctcaaattttagagtgttaataagaattacctcagatacttattgaaaatacagattcctgggtccctcttcctacctagtgagttcaaatctgtagaattctgacttaggtgatcttcgaaccacactttgagaaagttgtctgttgcatgcattcccactatcatgtaaattctgtccttcatatttttacataatctactttgttttaattactggaatctcagaagttttttactcataattattgataagctttttctcctgaattcactcattggaggggtcttccactaggtgtccaggaaatgttcccaaattcccttccatatttgtcagaatttatgttctctcctccccaaagcacatgtttatagttcagtgtagacatacaagtatatgtatacacatctcttttttactttttttttgaggcagggtctcactctgttacctacactggagtgcagcagcaccatcttggctcactgcaacctctgcctcccaaggtcaagcaattcaactgcctcagcctcccaagtagctgggactacaggcgcctgccaccatgcccggctaatttttatatttttagcagagatggggtttcactctgttggccaggctggtctcaaactgctgaccacaagtgatctgcccacgtcggcctcccaaagtgttgggattacaggcggtagccactgtgcccagcttgtatacacgtttaatagaccttgccagtgatttttagtatctgcttttctcactggggaaagaactatatctgaactttttaaattttagtcttccttggtgatgtgatacatcgtaggcatccaaatgtttgccttgaatttttactgctatcacttggttgctactgacacccaaaccaatcagacctactaaatatcatatattattatctttatacctgtaattttcctataccatttccttttctctaaattatcagaattttcttcggtgctatcttaagaataattcccttatattatattaatcttgaatcccattgacttttcctgaaaaaaaattaactcccatttccacatggatcttaatagttcaactctttatttacatgaatttttctcaaaactttgtgattccatgtagtagaaatgaaatataagtccaaatgatacacttcaaagacaaacccaagatacatgagtaaggaatcctgctcatcaactatctttatatgttaatcacattatactagtatttatttcaaagagatatatggactggaaggatacactttataatagagtacctcttgaaggggttgagtggtcaaagaaggaatattacttttatttgtaatgttttaatatttatatgagggacaataaatacataggtacatatgaacataccacataatttaagtacctacattgcaaaaacaatggaggctgggcagtggctcacacccataatcgcaacactttgggaggccgaggtgggaggatcacttgtcatgacttgagaccagcctggacaatatagatacagcgtgtttcttcaaaaattttaaaaaattagccaggcgtggtggtacatgcctgtgattcgagctactcgggaggctgaggtgggaggatagtttaagcacggaagattgaggctgcagtgatctttgatcctgccattgtactccagcctggcaacagagtgagaccctgtctccggaaaaaaaaaaaaaacaccatggaagcaagcaaaaaaaaaaaaattcctaaaatagttattccaggttgtgggaatatggatggctttcttctttgccctctttgttattttctttgttattgttgttcagatggagtctcattctgtcgcccaggctggagtgcagtggcacgatcttgcctcactgcaagctccacttagattgaagcagttctcctgtctcggcctcctgagtagctgggattacaggtacctgcctccacacccggctgatttttgtatttttagtagagacggggtttcaccttgtcggtcaggttggtgtctaactcttgacctcgtgatctacctagctcagcctcccaaagtgctggcattgcaggcgtgagccgccacgcctggccttgttatcttttttttttttttttttaaactttatacaggcaaggtctcgctatgttgtccaggctggagtgtagtggctattcacaggcactttcacagcacaatgcagcactgctcaagcaatcctctcacctcagcctcatgagtagctgggaccatagttggacaccactacactgaggtcttttggtttttttttcttacttttttttttggtggtggtggtttagtttaagcagcaacatgcgaaaaggtatctttaaaattcaccccagtttaaaggagggtaagatataatttagtggttttataaggaaacggcttctcagaatattttgtaaagggcaagaatcacgttttctatttcatgtgtcctttaacagttctaataagcaattaatgtttattatgattgaggtatgctgggtgcagtggctcatgcctgtaatcccagcactttgggaggcctaggtgggtggatcacctgcagtcaggagttcgaaaccagcctgaccaacatggtgaaatcccgtctctactaaaaatacaaaattagccaagtgtggcggtgtgtgcctgcaatcccagctgctttggaagctgaggcaggagattgctggaacccgggaggcagaggttgcagtgagctgagattgtgtcattgcactccagcctgggcaacaacagtgaaactcggtctcaaaaaaaaaaaaaaaagaaaaaaaaaaagaccaggcgcggtggctccctagcacttcgggaggtcgaggcgggcggatcacaaggtcagagtttgagactagcctagccaacatgatgaaaccccgtctctagtaaaaatagaaaaattagcgcccgtaatcccagctactcgggagactgaggcagaagaatctcttgaacccaggaggacgaagttgcagtaagccaagatcgtgccactgcactccagcctgggcaagaagagcaaaattctgtctggggggcagggggaagaggtatattttttggattaaaatggaatgctttcctcaaactgttaaaattaggtagtgttacaagtttaaagaataggtttagccagtgtgattattgcagtgtaataaaaaggatcccaggtggcacacatgctagtgtggtgcccagatgctcaactgaagtgaaggataacatgcgtttcaacattttctatatactaggcagtttttcttaagtcttggtttattgtgatataatacagtaaaatttactctttatacgtatgattccattaatattaacaaatttaaacagtcttacagctaaatacaatcaagatacagaacatttccatcactacaggaagttgttttttgctaatttaactaaacttcttaccatgctcaaccccccacccccaccctgagaaccactgctttgtttttctgatcatatagtttggccttttcaaaaatgtcatacagttggaatcatatagtatgcatgaatcatgtagctgaagttttcatttcacttaggtaaacacctaggaataggagtgctgggttatactctaagtgttaaacttcataagaagctgctaaactgttttccaaagcatctgtaccattttcctttcccaccagcaataaagcattcattagtctacgtactcaccagtgctagtgtggtcagaatgtatagttttaattatacacattataatagatgtagagtggtatctcatcgtgattttgccttttcctaatgaatatctttccttacatatttgtcattagtgtgtcttctttagtaaatggtcctattgttttgcccatttttaaaagttgagttttcatattgttcaatttcgagagttcttcatatattctggacacaagtcctttgtcagacatgtgatttgcaaatattttcccccagagtttttcctgtcttgtcagtcccttaatagtgtttttaggaaggagaacagctgcttttaattttgataaagcttgtcaattgtttttcttttatggatcatgcttttggtgtagtatctgagaactctttcttaaaccagtcacacatgtcttctgttttctttgaagctttacaggttgaggtacattttggtccatgatcacttttgagctactttttatatataggtagtataagatatggtttgaggtttttgtttggggttttttttcttcctgcatatgaatgttcagttgttccagcaccatttgttgaaaaaacactatcctttctctagtaatttgcttttttacttttgtcagttgactatttgtgggtctgtttttaaactccattttatattatgtctacattatgaactttatagttagtcttgaaattaggtaatgtgggtcttctcacttgtgcttttcaaaattgttttggctcttctaattctttcactttttccatataaattttagaaacagcttattgatttctaccactttcccccaaaaagccacttgggaatttgactaagtttacatcgaatctaataaatgattttggagagaagtggtatcttagcaatacagtcttttctgataacacttcctgttttagttctttttctcatttaataattttccaacattaaaaccttggacaaatttagatgtgtatctgaataattccagttttgttgccatttaaaatggtacataatccttattttatagatgagaaaattaagtaacttgcccaagtcacacagttactaaatgacaaagctagattgaaatctatgagcttataaactaatgtcctgttttgagctacagtactagttttattaaattgttgtggttaaactggggtagagaggaagtcctaacttcttttaagaaaaaaaaaatcccactactgtagttcataaaataattggtccccccacacttatgtattttcaaagattcagttttccagatctgttcaggtgataaaccatgcttttttttttttttcttctttctctttgagacagaatcttgctctgtcacccaagccggagtgtagtggtgccatcatagctcactacagccctgaactcctgggctcaagatatcctcccacctcagcctcttgagtagctgggactacaggcgcatgccatcatgcctggctgactttcttattttttgtagagaaaaggtctctcactacgttgcttaggctggtcttgaactcctgggttcaagcgatcctcctgcctcagcttcccaaagtgttgagattacaggtgtgagccaccacacccagcctccatgttcatcttagtttagaagccttcgattgacacatttctgaatcagtgattttcaaatagtataccttatccagcagttagtatgatttcaatgtgtgtacctttagcatgtgaatagttatttgtgctcaccagttgaaatacaaggaaaggattttttttttttttaaacaactctcagtcttgtgcgggggggagtgggggaggtggtggtatatactttattatagttcagccataatagatacatatggtcagtgggaacaacaaaaaaaagctatacttggttggggttacaatagttgcatttcatgttttgaagttcctttgataggtggatatttttacaaactgagaatatttgtagtcttaatttgctacttttcctgtgaaatgaagaatattctgatgttgagacctgttaaacattggtaacctagaagttgactttcttattttttaggtctctatgaataaagaaaagcaaatagaatcttatcagataagtgcttttataagtctaaatatattctttggaatctctaaagcaaaacttttaaacttttttttttttttttttttttttaggtaccagcatcaagatgatttatggtaataaggtactcagtctttgcttaaaataaattttacgtttatcaaagtaaaatttaccagctttttttcctaaagaggctagtcatatctcatcagtggttacaaagtatccttacaattgaacctacatttgttaatcctgttcagtgtgtatgaaaatcacttggtggccgggcatggtggctcacgcctgtaatcccagcactttgggaggccaaggcgggcagatcacaaggtcaggagttcgagaccagcctggctaatatagtgaaaccccatttctactaaaaatgcaaacattagtcaggcatggtggcaggtgcctgtagtcccagctacttgggaggctgaggcaggagactctcttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtccaggagttcaagaccagcctgggcaacatagtgagatgcggtctctacaaaaaatttttaaaagttagccaagcatggtggtgcttgcctgtggtcccagctacttgggaggctgaggtgggaggattgcttgagccatatgctctaatatattttaaaatacatattttaaatatattttgagtggtaaaatgtagcagataatgttacataaaagaagccatggtaatgacatgacattactggttttgagttgtttgtgtagtagttagctattaatactcaggtataatgatttgctatttaaactacacaaatgctcaaagtccagcgataccctgcacccaaattcagtggctagattaccttcttaggaaagcacaacacttcaatggagtgacactggcatgagtccactagagggtgtgtatacatggcctgagttcaaattgttcctgctgtgagtactgcttttcagcttcaagttattcttatcggccacagtactgtttattccacttagtaacagttctgtttacagagcactttaacataaattctgatttttaacatgaaagctgtctgatgttggtatttttattttaatctttagagatcaagaaatttttttagtgacagaatagggactttattgatccttaaatccgcccctcaccacaataaaggaaaaaagcaaaaacatccttgactcatgtattgaagggtcttttttgagaagggtcagtttttgaaaaattatccaaaactgaaacatctgtcatctgtatcacatctaaagattaacagtgactgatgaccaccagttacttcatatgaaagtgggaaaccgtatcagttatttgtccactaagttggtaggtgctttttgtacaaaagcccaggagaatatgatctgtaaattctagttgagtgatgaagatggggctttgaattaatctacagtcttggaattaattctgcagcattttaaccagggaatttttcagtagtcataaatctatattttaatactgagtaaatgtcctcatttacccccaccaattttgtaaagcagatattaaccaaacttcaatagttataagacaaaaatttaatgaaaattggacagtatgtataatccagggctaaatagttacattggactggagtagaaatttaaaatacaatagatgctggagtaaatgttacatattatcatcatctgattcatcttcttccttcagagattcctgttaagagaaaacaggtgtttaaaattgatttttaaaattgttatatcccacacctgtgggcaagttaagctacaacaacctgaattaagtggttaaattcctctacttgtaactgaatgaacagtttcagaataagatacccaagcaaagttaattaagcaaatgttgctctaacatgcaatgactgtatctttgatagaatatatacttaagaggcctggtgcagtgttcatgcctgtaatcccagcactttacgggggccaaagtaggcagatcacgtgagttcaagagtttgaaactagcctggtgaaaacccgtctctgtattattggtgaagccaaaaatacaaaagtagccaggtatggtggcatgttcctgtaatcccagctacttgggaggcggaggcaggaggatcgcttgaaccctggaggcagaggttgcagtgagcagagatggtgccactgccctccagcctgggtgacagagcaagactccgtctcaaaaaaaaaaaaaaaaaaaagaacaaatatttaaagtattaaaagtcctaaaaaactctttgcagtctaaacctcccaagttttttttttttggaaccaaggcaactttacccactagagataacctagaaaatttctatctttagttcaactgaactctcagtgttatttcatagaaaccaccccagtctatttatattattcaacacataattttggttagagaatttttttttttttaaattagggatgggggtcttgctgtgctgctcaggctggtctcaaactcctgggctaagtgattccctgactgtacctggccaagagaagtttttgtgctgtggcttaccttagcatatttctctgcttcttctcttatatcttttggaacaatttcatgtcttccattagttactgtaaattaagccacatgtgtaaatgaattttaaattgagtaccatattgtaacttgcagtataccataggatctacccaatccacatatctgactcacctaaggttgcaaagttgtactatgagtaatactcgaatatttttgtgtgctgcttctacatgagattatatgtgcctacatattaagttcttatggaaatgaaagtaaattatgctatttataaatcctgagcattaatttatagcatagtatcttaaaaccatgaaatggatgtttcaaaaaataacgtgttcacaacttaagtcaattattaagcagaactttcccttcattagacaacctagtaaatttgctttagctttcattatattagaaaggacactcagttgtaaattagctgtggtacagatcattcctaaggcaaataaatgtacaaaaataacttacattcaccaacccagctgagttctagttcaaaagctttatccttaacttcgtcatgtactatgtaaattctagaatagaaaagggaaaggtaagattttggtaacctccaaacattgaagtagttcacagacccaaagtcagtacaaattagaatgtccatccataataaaagtatctataaaattacacagacacattctacatagtatttaacattagagaagacaaattacacagggactgaaataaaatgaaacatctactctcccgacaaatgttgaatatacctaatcaacccaagttcagtttatttttgcacattgctttagagatataacttggctgggcacagtggctcacacctgtaatcccaacactttgggagaccaaggcggatggatcacttgaggtcagttcgagactagcctggccaacatggtgaaaccctgtctctactaagaaacaaaaatcagccaggtgtggtggtgggcgcctgtaatctcagctactcaggaggctaaggcaggagaattccttgaacccgggaggcaggggttgcagtgagccaagatcacactactgcactccatcctgggctacagtagagcgagactccatctcagaaaaaaaaaaagatacaactataaaagatacctcataaagaacacggattcactaggaagaggcgtcattaactgtgcccttttagaatattttgtccattaacttaaatatatttaaaaccaactaattggctggacatggtggctcgtgcctgtaatcctagcactttggggaggcagaggcgggtggatcatgaggtcaggagttcgagaccatcctggccaacatggtgaacccacgtctctactaaaaatacaaaaattagccaggtgaggtggccataggcctgtagtcccaactactcgggaaactgaggcaggagacttgcttgaacccaggaggtaggggctgcagtgagctgagatcacgacactgcactccagcctgggcaacagagtgagactctgtttcaaaaaaataaaaaaaaaaaaactaatttatgtgcttgcaattattagtggtctcttcaacctatagcttcttggcagtagtctttttaagctccttgtccattttataatggcatatatgccacataacctggccttcacattgtagtaccttacaaattacagcaaagaaggaggcactgtcatgcaacatattaaagtaacataaaaagtatcaagaggccaggtgcggtggttcacatctgtaatcccagcactttgggaggccaaggtgggtggatcacaaggtcaggagttcaagaccagcctggccaagatggtaaagcctgtctctactaaaaatacaaaaattagccaggtgtggtggtgggcgcctgtaatcccagctacttgagaggctgatgcaggagaattgcttgaacacgggaggcggaggttgcagtgagccaagatcgtgccactgccctccagtctggacgacagagtgagactccatctcaaaaaaaaaaaagtatcaaattaagtacagtagcagagtatagctttatctaatactatgcactgagttacataccttactttttggagggtcttctaaaaccttgctataatatgagaggatcttgattttctacaactaagtaaaagataacatgctgctccattttcttaaatgatgaagggatggctttcctaacatggaacacttaacagatgactaccattatacctaaatataaaagatggtaagaactgatttccagaaggacttcaaaggattggttcggtgaaggaaacagagtatatcatgataacatactatacaattcaaggaagatatctgacttcctttcttagcagctctgctgcatgttggttcctagtgttgccattattaactgacaatcatagaatggcttctgcttgcttcacaactgaaactaggagggcggaggggaggaggtggcaagaggggtaaaggcagtagcagtaatgatggaccggttaataagagactctgagtgtgatgtaaatagtatgtttattaaacaatagagcccattggaatttttttcttccacgtattgttagatgtaaaacctgatacactaccatacagacaggtgattgactagaccttgtttatgtagttctaatgtggaatacttagagttgttatgaattacgattatccataacttttgaatctaaaaagctggctacacaacgtattttgttggaatctttttgtaataccaaatgtctacactctttgatctagagaatcacaaaattttagaaacatcactacccaggttaattgacttttttattgtttactgtccaaatacctgttacatattaatagtattctactttatatacctgtaataaactattcagggtttcttaagctggttgttgaaatgttttgtaatactgctcttcttaccttgttataggaacttttataataaacctgaaaaagtgaaacatatctttcccaaataaatagcagattatataaatgagccagcttcatggatcatgtattgaaataattagttgtaacctataaagtttgtaagcattcttacaatagaggcaatcttaagattactattattaggacttaagagatttgagaagttgggagctaacaaattaagaccctaatggtatatgtccttaacctgtaacaggagtttattttgtcaagctatttttcccatcctattcattactactaaaaaatattgcttaaaaacattttcttccttcgtgaggcttcttagaatgttaaatttaccttctaaaaattatacactaagttattttacaggaaaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttgatttttctctgggatttattgtttttcccattccttgctaggatttaactacagaaagacagatagtaactgctctaaatattctaatttcctttatttttttgagataaggtgtcgctctgttgccctggctggagtgcagtggcgtgatcatagctcactgtagcccccaactcctggctggggctcaaacagtcctcctgcctcagcctcccaagtagctgggactacaggcacgcaccacctcacctcgctaacattttgttttgggagatagggtcttactcttttgcccagcctggtcttggaactactgggctcaagcagtcctcccaacttggcctaccaaactggtaggattacaggggtaatccccctcaactgacataaatattctaattttcaaatttccatataatagtatggagagatgaaaacaaaaggaaaagagtagaagataggaacctagcatcatactagtaagtgtgcaatggaaaagaacataggtctaagactcataaggtctggatactgttcagaaccagctgattctgtggtcctatgcagtgtgtttaatctgcagttgagcttgggctaaatgacctctaagatccttttgtcagctttactaaaatacgaaacaaattaggttttatagggggttctagaacttagcattgtataaatgccaagcactaataagtattttctagaagctggtcttaaataagttgaatgagtaattagttgagcagggttctagtacagcattaacattaaatgtatgtgaaattgtatctcacttcagtttaccaaaacactgataaatggtatgcctgctttttaggcaagtttctgacaggtaatcaataatattgaaacagtatccatgaagtctttaagttgatcaacgcatggctaaaaggaaaaccaagtttttaagaaaactttttcacactaatagctgaattttgtgaaagaaaaagtgggtagtcgtaagagtgtaggctttatgccttacctggctaggagcaaagctaagagaaccggtggagcacagccagacataaaagctgtgttccaaagaaagaatataggaaaaatataactttttattaactcaaaattttaaacaaaattttcaaactagagctcacagagattcataaataggtttcaaggattttgtgaaatcatatcaaaagttgtgtttttctagattgaggctttatagcagttattcagaatctataaagggatgtataacacaactctacagataatatgttaccagctttcccattcagtgacttagcagcttcataaactctcaacatcaaaccacactatatccttacaccgagcttccccagccacaggccacatggggccaaacacaaattcgtaaactttcttaacacatgatgagatttttttttaagctcatcagctatcattagtgttggtgtattttatgtgtggcccagggaagccaaatgattggacatccctgccttagactgaaatgtctgtggtgataaaatttcactgcattaggatgacgacatagtaaaaattcaagcattaattattacctgaagcttctctatttccgtctttgcagcttgcctggctttgccgatggcacagccccaataaccctatttagaaaaaaatatatataatcactgaattagtacactatcatatgtaattaatgactactaatgtttctataacctagtgaaaggatgctaaatgacttttaaaagcaagtatagaaaaatatagtcaaacacattctgatgaatgccaaagggctcaaaaatactaaaataccaaacaattccaaaacaacctgtatttttaataaaggtatatccaaaaatatgtaaattatgtaatcatatacactttaagacattttggggaacaggaacggaaaagattttagcactatgacaatgaaaaatgaaattatatattcctgagagacagaaataaagttaattcctatgagttcagtactctaaacccccaattttattattttgtaaatttttttaaagataaggatgcacagctgggtgtggtgggtcatgcctgtaatcccagcactatggaaggccaaggtgggcagatcacctcaggtcaggagttggagaccggcctggccaacattgtaaaaccctgtctctactaaaaatacaaaaaaattagctaggtgtggtggcaggtgcctgtaatgccagctactccagaggctgaggcaggagaatcgcttgaatctgggaggcagaggttgcagtgagctgagaccgcgccactgcactccagcctgggcaacagagtgagactccatcaaaaaaaaaaaaaaaaaggatgtacacatatatacttctgttacagcaaaatatatttaagaatcttcattttcttcaattagtaaaaacgacaaaaatgtaaggataagaaaacagttaagaaacggtaacaggccgggtgcagtggctcacacaaagtgcttgtaatcccagcactttgggaatctgaggcacgtggatcacttgaggccaggagttccagaccagcctgggcaacatggtgaaagtctgtctctactaaaaatacaaaaattagccaggtgtgatggtacaggcctgtaatcccagctacttgagaggctgaggcacaagaatcccttgaatccgggaggcagaggttacagtgagccaagattgcaccactgcagtccagcctgggcaactgagcaagactctgtctcaaaaaaaaaaaaaaatggtaataatttagggaaagctcttagaaatcacatttaaaccttctctttaaaagggaaggcagggcaaggtggctcacacctataatcccagcattttgggagaccaaggtgggcggattacttgagatcaggagttcgagaccagcctggctaacatggtgaaacctcgtctctactgaaaatacaaaaattagccgggtgtggtgatgcatgcttctaatcccagcctactcgggaggctgaggcagaattgcttgaactggggaggtggaggtttggcgccactgcactccagtctgggtgacagagcgagacgctgtctgaaacaaaattaggtccggcactgtggctcacgcctgtaatccttgcactttggcaggccggggtgggcagaccacctgaggtcaggagttggagaccagctggccaacatggcaaaaccccatctgtactaaaaatacaaaaattaaccaggcatggtagtacatgcctgtaatcccagctaatcaggaggctgagacaggagaattgcttgaacctaggaggcggaagaggttgcagtgaaccaagatcgagccactgcactccagcctgggagacagagtgacactccatcttataaataaataaaataaaagggatgacatggctggacatcgatgctcacgcctgtagtcccagcattttgggagtccaaggcaggaggactgcttaaggccaggagtttgagaccagccctgggaacgtggaaagaccttgtctctatagacaccaaaaaaatacaaaaattagctaggcatggtggcatgagcctgtagtcccagctacttgggaggcttaggtaggaggatcgcctgagcccaggagttgagaggctgaagtgagctatgattgtgtcactgcactccagcctgggcaagaatgaggaaaaaagacattaaatacagttttaagacagtgtttatagtaataaaggaaaatcacatattcaaaatactatatgcactatacagtttctataaataacatactgaaaaaaaatctttcctctgcctcgtatcagttattaatgataagaaaacatggctgggcctggtggctcacacctgtaatactcgcactttgggagacccaggtgggtagatctcttgaggactggaattcaagaccagtctggccaacatggcaaaggcctgtttctactaaaaataaaaaaaattagccaggtggtgcacacctgtaatcccagctacccgggaggctgaggcagaagaactgtttgaacctgggaggcagaggttgcagtgagctgtgatcacaccactgtgctccagcctgggccacagtgagaccctgttcccccaaaaaggaaaaaaaaaaaaattctgttggacaagaggttgttgtaaaaaaaaaaaaaagaaaaattactttccttgaatgagtttttttttaatttcatataatcttataatgagacttaaatgctaatgaaataccattaaactaaaatagaatttcaaatgattcaaaattactcacgtatgaaacacctgatgggtcaatcatgtagagttgcgcaccgtcattcacactgtaagaccctaacatgaaactgcatgaaagtatacaaacagcttaaaccatggcaataacataaaagtatttgtgaaaaaattattttaaaatgcagttatattttctttctgagataaattactaatacacatataactcagtaagtactttgaaacagtggtttcaattaattaaaactattacatgagattattcaaaattcatgtagcttttgtttgtttagtattaatctttctgatgaaggtctcctggaaagtctagcagtacagggaaaggagtaacgatagatgaaaaccacaactatgagagggcccaataaataaggcataaacacaaaaagatcaagggaacaaaattcctgacggagagtatactgaatccatgtgaaattctttccacccttcattctatttcccaatatcctgccaatcatttctctgcaataatcagaattggttcagtgtatttttctgtgctcaacaaattaggctattagctgattgtatgaaatactgattttctgaaattgtgacatacagtgggcactgtttccatgagttctgcatctgtggattcaacaaaccacagatagaaaactttcaaaaaacattgcttctgtactgaacaactgtgattttcttgtcattattccctaaacaatacagtgtaacagctatttacactgtgttaggtattgcaagtaatctagagatgacaacatacaggaggatatgcacaggttatatgcaaatacttaaccattttatatcagggacttcagcaaccttggattttggtattcatgggaggtcctaaaaccaatcccccacaaataccaagggacaactatatttgccttagagtagaaaagaaatcagcagcatcttacacatcatcttatatgcggaatattttaactattcaattcccatccctaccgtcatttccttccattttctaccgatatgagacttatccttcaggatatatagctcattgtcactattttaaagcctttcaacatttctttgaagaaaatcagcatggagcacagacttttatatgactggaccccttcctacatcagtatcatctctaaacctcatactctacacaccaagcatacttaactctctctggcgcacgtattttcataccagttcctgtgcttgcaactaccaagtctccctacatctcacactcttccttgcctcctgtccagaaagagtccgttccctaattgttgtccctttatcatatcactaatattttatcaatgtgacttcacacctgtgtctccacatttatgactaactcagtgcccaatagatgtttactaaaaaagttctctctggcccagtgcggtggctcacgcctgtaatcccagcactttgggaggctgaggtggatcacttgaggtcaggagtttgagaccagcctggccaacatggcgaaaccctgactgtactaaaaataaaaaaattagccgggcgtggtggcaggtgcttgtaatccctgctactcaggaggttgaggcaggagaatagcttgaacccgggaggcagaggttgcagtgacctgagatcgtgccactgcattccagcctgggcgacagagcgagactccatctcaaaacaaaacaaaacaaacaaaaaaaaagttatgaaaaaaagttatctctactattcttactcccttaaaaagagtagagaagttaactgatgaactcagagctcagttgaaaggtattttacatggtctgaaaacaaagtgtttcataatgtaatttaactgagaagcttaagaatgactaatgtcagcctgggcagcatggtgagaccccgtctctacaaaaaaaaattttgttaattagccaggcatggtggcccatgcctgtggtcccagctacttgggaggctgaggtaggagcatcgcttgagccaggtcaaagctgcagtcagccatgatggcaccactgcactccagctcaggtgacagtaactgtctcaaaaagtaaaaacaaaaccctaatgtaatattaccaatagaataaaactcaagttttctttaatatcttagtaattaaatatgactgatgataaacaactcaaaggtaggactacagctgagcactcagatgttagtatatgtattattttgaccaaacatgtttgactgttttaagtcataagccaaacatgtcttttcattttagaaaaatctagtcacaagtcttctctgtgaagccaaatttgaatatttatacctattccaggtctttatgcagctgaatctccactttaccccacaataaaatatcagcacttcaacagaaagagaaaccgtgcctaatgggaattgtgagacgtaatttttaaaattacctaagaatatcagggactaacaccgagagcttattataatcagattaaagtcattgttatcagttccttgttttataatcacttcagatctatatagtccttttcactattgaaaccttttttttttttttttttttttttttaaagaggcagagtctctattgcgccagctagagtacagtggtatggccacagctcattccagccttcaactcctgggctcaaatgatcctctcaagcagctcctaagtagctgtgactacaggcatgtgatactgcacctggctaaattttaaattttttttgtagagataggttctcactgcgttggccaggctggtctcatactcctgggcgcgagggatcctcccacctcaacctcccaaagtactgggattacaggcttgagccatggcacccagcctcaagtagtttctatgtacactgttttatttaatcattgccctaatacttatcgacgagtttctatttttaagtatgtaaaaggctaagatgctggggaacataataaatatctatagtacagatctgccttttgaataattcacaaaatttcttacctgcagccaaaaggtctaacagcactgtagagtgtatatgcatgcacatacatggccactctgtctgcaagatgctatggagggaagcagaagagcttattaataaacttctattactgtccaaaaggttcctcaatatgttatcaacttacttttagtggaatgttgtagccaaagttagatctgaagttggaagcttcttctcttgctatgtctgctaaagaacgagcatctgccaacaaacctgctactgcctgaaaaaaaagcaccaatttactagaggaacacattcctatcacaaatcaaagtctgcaattaataaagacttattaaacatttttttaacaagtattaccattcaaaataaacttttttggcttaaaggtctctctacaaggcattttgatgcttgagtatgaaattataatttagaaatttagtaagtataacttcattgctttgtccaatgttcatattcaggacatttccttttttttttttgatacggggtctcgctctgtcaccagggctggagtacagtggcatgatctccgctcacttcacactctgcctcctgggttcatgccattctcctgcctcagcctcctgagtagctgggactacaggcgcctgccaccacgcccggctaatttttttgtatttttagtagagatggggtttcaccatgtcagccaggacggtcttgatctcctgacctcgtgatctgcctgcctcagcctcctaaagtgctgggattacaggcgtgagccaccgtgcccggccaatattcaggactacttctatcataaatcctcttcccctgatttactaccactacctcattataacgaataaaaaccatgggtcttggtcagatttttttttttttttttttttgagacagagtctcactgtgtcacctaggctggagcacaatggcaccatctgggctcacttcaacctttgcctctcaggttcaagggattctcctgcctcagcctccccagtagctgggattggctaatttttatatttttagtagagacagggtttggttttgtcatgttggccaggctggtcttga

SEQ ID NO: 5916 - DNA, 589 bp, Homo sapiens
tcctcgcatctcttcccgaggccctctctggcctgcagccggctgctgaggcggccgtagtcggcctccttctggtcgatctgtttcttgtgcgtgtccaccaacagcaagaggtccgaattgcgcttttccagccgcccgcgggccacttcggtgcgctggacctggccctgcagctcggccacctcctcctgaagcaggacgtggcgggaggagatgctccagtagttgaaggcgaggacgacgatcaccaccagcagcaccaccagcacgagagagggcaggcggccagcccgccggttggccccgaaacccaccatggggccaaatcgggctgtaccctaggggcctcgccgcagacacctgcaggcagaagcccaggcctcggctggagttgcccggcggacacggccccagggccggccgagggaggaggcgggcttaccggtcggctgcgagccggagaagggggccaaaacgcgttccggaggctttgaacccgaccctgcacctgcccaagggaaccgggagaacccagctgccagcgtcccccaaacccaacacctcacggttgggaggcggggaaaaa

SEQ ID NO: 5917 - DNA, 1219 bp, Homo sapiens
atgagtttcaccactcactccaccttctccaactactggtccctgggctccatccaggcgcccagctgcggcacccagccagtcagcagcacggccagcgtctatacaggcaccggaggctctggttcccagatctccgtgtcccgctccaccggtttccagggcagcttggggtacaggagcctggccatgggatggccagggttctagcaggaatgggaggcatccagaacgaggaggagaccatgcaaagcctgaacctaccctggttcaatgcctgacctcctacctggacagagtgaggagcctggagaccgagaaccagaggctagagagcaaaatccaggagcacctggataagaagggaccccaggtcagagattggggccattacttcaagaccatcgaggacctgagggctcagatcttctcaagtactgtggacaatgcccacattgttctgcagatcgacaatgcccatcttgctgctgatagagtcaagtatgagacagagctggccatgtatcagtctgtggagagcaacatccatgggctctgcaaggtcaatgacaccagtgtcactcggcttcagctacagagattgaggctctcaaggaggagctgctcttcatgaagaaccgtgaagaggaagtaaaggcctacaagcccagactgccagctctgggttgacgatgaaggtagatacccccaaatctcaggacctcgccaagatcacaggagacatcctaatacgaagagctggctcagaagaactgagaggagctagacaagtactggtctcagcagattgaggagaacaccacagtggtcactatgcagtctgccaaggttggggttgctaaggtgacgctcacggagctgagaggtacggtccagtccttggagactgacctggactcgatgagaaatctgaaggccagcttggagaacagcctgagggaggtggaggcctgctataccctgcagatggagcagctcaacaggatcctgctgtacctggagttggagctggcacaggccggggcagagaggcagcaccaggcccaggagtacaaggccctgctgaacatcaaggtcaagctgtaggctgagatcaccacctaccgccgcctgctggaagacagccaggacttcaatcttggtgacgccctggacagcagcaactccatgcaaaccatccaaaagaccccacccgcca

SEQ ID NO: 5918 - DNA, 8598 bp, Homo sapiens
attgcaagcctctgcagaggcgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcaggtttttcccagaccttctcctgtcccgcgttccccctaggccggccgtagggaccagaccccaccctaagcccatagccggccttcgcgctccgggtgaccctggctggccctgtttgtctgtgggtcctgggatgcgccactcccggcaggaaggggcgccgccgaggcccggtctcagcctggaaccccgctcctgccgtcggggcgctttctgcggctgcccacacacgaccccaggcaaggggtgggggcgcgggaccctccatgacatggcggcggggcgctctcacttctttgaaaccagcgtaaactggacccgccccacctcccataccttgggggagccccgggaaaggctgtggcctgggggtctgcagggcgttggcagtggaggtggggagagaccccagccctttcctgtcccccccaccagccttgccttcctcgccgtgagccggggacagtggaggggagtcagggagggcccaccagatggactttcttgtgactcatcctataaagcccctcgggcttagccaccctccccaggacccgtgtggtctcccggactgtgctggaagcttagagccagaatgacttttccaccctcgggctggctggctcagtgggcagcagggacagggggctgtgaagagaaaactcactcgccagggtcaggggccgcttgctcactgaggaaagcagaggggttcctgccgcttgcctcaggaacaaagctagttggtgaggcactgccttgcagttgtaggagaggaataatggcccccgtgggtgcttggttggaacgattaaaggagaataacagtttagcacgattatttcacacagttgttcaaagagatggctttgaattccagcttacatggcgtcttcaacaaaaagtaattgtttagagaagtgacaagatgaaggaggactctgagtcctagtctccctcctcgagtccctgtgtgagcagaggtaaacaatgaaaactcaccaaccaggagaaattcacctaggactggcgcagaaggtatacaccatgagcctggaaatgatttaaaaaacaacacaggctgggcgcggtggctcacacctataatcccagcactttgggaggcagaggcgggcggatcacttgaggtttgcgagttggaaaccagtctgaccaacgtggagaaaccccgtctttactaaaaatacaaaattagccaggtgtggtggcgcatgtctgtaatcccagctactggggaagctgaggcaggagaatcccttgaacctgagagatggaggttgatgtgagctgagatcacacaattgcagtccagcctgggcagcaagagtgaaactccatctcaaaaaaacaaaaaaaacaacccacaactgtgggccaaagggacacagcgacaaggggtcccaatgggcgaggctggaataacttgaatagcagaataaagtagcattggattataatgcacagggctgaagaaatatcgatgagtctttgctgatgtaataagtgactgaatgagctgggcagagtgggacctgtagttcagctactcagaggctgaggtgggagcatcagttgagcccaggagtcaaggcctagtaatatcccatttccaaaataaaagactgaattaataaatagatgggagagaggagacaattgaccatgcaggaggagtccaaatatttgttctttgaggcaggatcttcctctgtcattcagaaggctggagtgcaatggtgcgctgttgccttgctgcagcctggacctcctgggctcaggcagttgtcccacctcagcctcccaagtagctgggaccagaggcatgcacatccagccgagtccaaatagtgtatgcagatatgccctcacagaggtgacctgaactttctgagttgtgagtgagcttcacctggggacctccttttaggtagcagggaaaaagaggagggtgagccacacccaggcacctccttccagagagcatgtgcctcagcctccagagtagctgggattgcagacatgtgccaccagcccgactaatttttgtatttttagtcgatacgggggggtctcactatgttgcccaggctggtcttgaactcctgggttcaggtgatcttcccacttcagcctcccaaagtgctgggattacaggtgagataaaacttccttattcacagactacatgattgtctatatagagaacactcatctaaagcaacagcaatgattgccacaaagaccctcgtagagccagtaagtgagtttggaatgttcaccagtaacacatacaaattaatcttagggctgcgtgcagtggctcatgcctgtaatcccagcactttgggaggctgaggccgaggctggtggatggcctaaggtcaggagtttgagaccagctgaccaacatggtgaaaccctgtgtctactaaaaataggaaaactatccaggcatggtggcgggcactgtaatcccagctactcaggaggctgaggcaggagaatcgcttgaatccgggaagcagaggctgcagtgagccgagatcgcaccattgcactccagcctgagcaacaagagtggaactctgtctcaaaaaaaataaaagacccggtgtggtggctcatgcctgtaatcccaacgctctttgggaggctgaggcaggcgtatcaccaggtcaggagttggagatcagcctgaccaacatggtgaaaccctgtctctactaaaaatacaaaaattagccgggtgtggtggcacacacctgtaatcgcagctactcaggaggctgagacaggagaattgcttgaacctgggaggcagaggttgcagtgagctgagatcatgccacatttgaacccgtgaggcagacgttgcagtgagccgagatcatgtcactgcactccagcctgggcaacagagccagactgtctcaaaaaaaaaaaaaaaatcttacttctatagacaataaaacattggaaactgaagttaaaaacacagtagctcctgagagagagagagaggtataaatctaacaagacaaaacaggatctgtatgctaaaaagactatgtatgtggagagacggcacacagcacgctcatagactggaagactgaacataagatgccagtctcagaaggatctgtgaaattaacaaaattccaaaacattgcagtaggactctttttagatttagaaaagatgattttaaaatgtatacagaatggtgaaggagctagctaaaacagtaaaaaggatagataaaacaatgttttaaaaagaacaaaaaagttagatgaatcacattacacagttttaacagactttaaagccacaaaaatcaagactgtcgtattggcaaagaacagacagatgggtcagtgatcagagagtctagaaacagacccacataaatagggccatttgatctttgacagcagtgcaaacaaaagcaaccctgtggagaaaggattgtccattcaacagagcagtggggcagttggtcatccatatggtagaaatggaaccttggcctaaacctcacattgtacacaattaactccaatcatatgtaaacgtaaaacaaaactataaaatgtttggaagaaaacagaaaaatacctttgtacctgatgacatttggtagagttcttagacatgatcccaaaggcataatccacagaagaatccataaaagaaaaatttgtaaattggactttatcaaaattaaaaacttacttttttgagatagggtcatgctgtgttgtccaggctggagtgtggtggtaagtcatagttcactgcagcctcgacctcccgggctcaagccatcttccttcctcagcctcctgagtagctgggactagaggtgcaagccactattcctggttttaaaaattttttccagagtctgagtcttgctgtattgcccaggctggtctcaaattcctagccttaagtgatccttccaccttcggccccaaagtagttgagattacaggcatgagccaccgtgcctgacctaaaaacgtttgaactaccaaagacagtgtgaaaagaatgaaaagatgaggagaaaatattcacaaatcacctgtcaactaaggacctgtatttggaatacacagagaactcttaaaactcaacagtaagaaaacagtccaactaaaaagtggaaaagacctgatcagacatgcaccagcaatgacacagcattgactgttgggcacaggagaagaggcttgacaccaccagccaccaggaaatgcagattcagccaccacgcaggacacgaggcacctgcaccacagccgcagtgcaagagaatgctggtggtgccccaagctgccagggtgtggacctgctggaaatggaagacggcatggtggtttcctataaagttcaatgtacacagccacatgacccagcaatcccactgttgggtatttagagaatgaaaaacttaagtccacataaaaactgtacgtaaatgtttactgatgccttattcataatcatcaaaagctgaaattcaaatgcctttcattgggtgaactggtaaactgtggtatatctatgcagtgaaatactcctctgcagtgacaatggggagagactgacacattgggcaccatgggggtgggaagaggtgaaggaaggttgggggaaggcgccgtggtcaggtgtggcactaaggagatttgggggtggagccattctgtgtgtggactgtggtggtggtcgcgtgactgtacatgtgttaaagcttcaaacaaaaaagttaaaaattttagtttaaaatattaaaacatttttaaaaatggacacgtattcctgaatttttttttttttgagatggagttttgctcttcttgtccaggctagagtgcagtggcgccatctcggctcaccacaacctctgcctcccgggttcaagcaattctcctgcctcctgagtagctgggattacaggcatgtgccaccatgcctggctaattttctattttttttaatagagacggggtttctccatgttggtcaagctggtctcgaactcctgacctcaggtaatccacctgcctcagcctcccaaagtgttgggattacaggtgtgagccactgcccccggcattcctgatttttaataagctgtaacagaagataatttctctatttggtaaatggtatttgtcaaaaccctgcagcaatcatgcttaagtcaagatatttaaagtattcccattaaagtcagacaagcacagttctccttgctatcactgtgagtgttttccagacatcccagcagggtgagagaactgaaaaagagggaaggagatgaatattggagacagggtttagtagtttgttgatgatacaatcatctgcatgtaaatccaagaaaatcccctgaggaaccctgaggaccagccgaggagttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtacattcattgcaatcctagttaaattctgatgagattaaatgacacaggataagctgcttctggagctgatctaacagaagaaaagccaacattaaaaaaaaggctgggtgaggtggctcacgcctgtaatcccaacactttgggaggctgaagcaggcggatcatttgtgttgaggaatgtcatttgtggtcagcctggccagcatggtgaaacccatctctactaaaaatacaaaaattaggtgggtgtggtggtgggtgcctgtaatcccagctacttgggaagctgagacaggagaattgcttaggcctgggaggtggaggttggtggtgagctgagattgctccactgcattccagcctgggtgacagaatggtactctctctttcacacacacacagacacacacaaaataaagaaaaagggctggcgtggaggctcctgccataatcccagcactttgggaaaccgaggtgggcagattgcttgagttcagttcgagacgagcctgggcaacatggcaaaaccccatctctacaaaaataaaaaattagctgggtgtggtggtgcctgtagtcccagctactctggagggtgaggtgggagtatggcttgaggccaggagcccgaggttacagtgagccatgattgcaccactgcactctggcctgggtgacagagtgaggccctgtctccaaaaaaagaaaaaaaaccccacaccataaagggggtcctactgtgtccggaattggtgggttcttggtctcactgacttcaagaatgaagccgagggccctcgtagtgagtgttacagctcttaaaggtggcgtgtctggagtttgttccttctgatgttcggatgtgtttggagtttcttccttctggtgggtctgtggtctcgctggctcaggagtgaagctgcagaccttcgtggtgagtgttacggctcttaaggtggtgcgtctggagttgttcattcttcccactgggttcgtggtctcgatggctcaggagtgaagctgtggactttcgcggtgagtgttacggctcttaaggtgctgtgtctggagttgttcattcttcccactgggttcatggtctcgatggctcaggagtgaagctgcagaccttcgtggtgagtgttacggctcttaaggtggcgcgtctggagttgttcattcttcccactgggtccgtggtctcgatggctcaggagtgaagctgcagaccttcgtggtgagtcttaacagctcttaaggtttcgcgtctggagttattcattcttcccactgcgtctgtggtctcgatggctcaggagtgaagctgcagaccttcacgatgagtgttacagcttttaaggcggcgcgtctggagttgttcattcttcccactgggttcgtggtctcgatggcttcaggagtgaagctgcagacctttgcggtgttacagctcataaaggcagtgtggacccaaagagtgagcagcagcaagatttattgcaaagagcaaaagaacaaagcttccacagtgtggaaggggacaggaccaggttgccactgctggctcgggcagcctgcttttattctcttatctggccccacccacatcctgctgattggtccattttacagagagctgattggtccattttacagagagctgattggtccgtttttgacagggtgctgattggtgcttttacaattcctgagctagacacaaaagatctctacgtccccaccagggtagctagatacagagtgtcgattggtgcattcacaaaccctgagctagacacagcgtgctgattggtgtgtttacaaaccttgagctagatacagagtgccgattggtgtatttacaatcccttagctagacataaagcttctcccaagtccccaccagactcaggagcccagctggcttcacccagtggatcctgcgctggggctgcaggtggagctgcctgccagtcttgtgctgtgcgcctgcactcctcagcccttgggtggtcgatgggactgggtgccgtggagcacggggcagtgctcgtcggggaggctggggccacataggagcccatggaaggggtgggaggctcaggcgtggtgggctgcaggtcccgagccctgccctgccctgcagggaggcagctaaggcccagcgagaaattgagcacagcagctgctggcccaggtgctaagcccctcactgcccggggccagcagagccggtcggctggccgctctgagtgcagggcctgccgagcccacgcccacccggaactcttgctggcctgcaagcctgcccacatccctggttcccacccgcgtctgtctctccatccacacctccctgcaagctgagggagccggctctggccttggccagcccagaaaggggctcccacagtgcagcggcgggctgaagggctcctcaagggcagccagagtgggtgccaaggccaaggaggtgccgagagcaagcgagggctgagagggctgccagcacactgtcacctctcactaccagacccgagcagagctgtggacaacacagtatgggaattaagcaggtgagatgaccagagtcctcactggcactagaagatggcagcccaggagaaagctaccagccagagcgaggcctg

SEQ ID NO: 5919 - DNA, 4873 bp, Homo sapiens
catttctttatacacctaagttgaatgtgaagtgtaattgaacagtttttgtcgtcaaaagttttaaaatcttggtcttcatttccagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcagtaagtatacacataagtatgaccgtaaattaggaataagattatttatgtaactgctgaaatagctgacatagactataccaccttacagtattgctttaattatcataataaccgtgttcttccctgaacttcaccagcaaatggatttctgttcagggccatttttttacaaaggcatgaatttttattttgtcagaaaataatgtacattgagtagagagcagtagagctgagttgaggtaccacgttatcgtttatgtcattaagtaactttttcctatataatatttgtttgacttcctaccacgagattcacatgggtactgtgttattcctgaagagataaagtaattctgaatgctaagaattttcctaaaggttgagcatcccaaatctaaaagcctgaaatctaaaatactccaaaatctgaaactttttgagtgctgacatgaagctcaaaggcaatcatcactggaacattttggattttggatattcagccagtaagtaatgcaaatattccaaaatccacaaaaatctgaaatctgaaacacttctggttccaagcttttttgttttgttttgttttgtttttttgagacggagtctcactctgccacccaggctggagtgcagtggcgcgatctcggctcactacaacctctgcctcccaggtgcaagcaattcttctgcctcagcctcccgagtagctgggactataggcgcatgccaccatggctggctaattttttttttatttttagtggagacgaggcttcgccatgttggccaggctggtctagaactcctgaccttgagtgatctgtctgctttggcctcccaaagtgctgggattacaggggtgagccactgctcccggcctacttccaagcattttggttaaggaatattcagtttgtactatttgacccagactactcagaaaaagtaatgtaatgaagaatgaaagctgtagttgtagtgaagtaaataggagactgctgtgtgatgactgaccaaaacgatttgtattaatttatcttgaaaacttgtgagcaaagtctgactaaaaatttaaagttgtgactggtatggctgcatgaaacaagtgtcagaatattagaatgaaggtacatgatgtgaagtttcagaaaattaagtgggcttcacataggtctcatttcatgaggaaagtcagataatttcaaaatgtagtaagcttatcgtcaattcctgattaatattggtttgttgaaggttgtggctggtaaaagacatgtcatatattgtttttgtcaactcagtatctcttcattagagaaccacccctcccctattctgagtggttggtgggctgtccgtcagtcttactgtcttataacctgagcttggtcatccctattgcaacagtgattgctgttactcatgcagagccagtcagaatcctttttttgaaatttatggttgaatgctaggacaaagatactaccttttctctgaaattgttaatctgggaaggtgctggtggcattctttaccacgtgtatgaaaagcgcatctgtgtagtgggagaaagtgaagccataaggagatgggagatggatggtggtagtgccagtttcaatctcagggaacatggtaagtggtacctacttttcttttgattttgtgaactatcctggtgtccttctcagtccttgtgccaaaattttttgtgtaaattggtttgaattggattgcagcagaaagtgttctgatgaatatatggcccttatgaatttaaggtctaaagtttcagattgatcattcacatccttctgtagttccccactttcctataccttataaagagttccctttatttattcatcatttgtgcatgcattcaatctactttcactcaacctacaaacatttttttgagtgtccactatgtacaagtatgtgcaactgcctggataggcaagattatatgtactagactgagtggatggtggatatatagcatatttttatttatttctggtgcacagattaataagcgtgtgttgagaataatgactgtggtgcttggcatctaagtaataatgtaagaacaagaagaattccttgtcttggaagtgcttctagttaggaattcatattaatatacagcaaacacaacagaaaaaacagataaatgaatgcacagttgtattttaagtgaattttgatgggaaggaagtgagcaggttggcccatttaggaagatttcctgaagaatatacaactttaaatgtatttctgcttatgaatgtggctttgataggcacagagaataactgaaaaaaggatggagttaaaaatgattataggctgatccaggttggagtggagattggtttcactgtaacagtatgtgttctttggaaatgaggtagtggaaaataaggtgactgttttaggtaaatctatgtatgaggcatttggaaagccaagcagaaattttggccctttctactaagatggagatttctttgaaaaaatgtgtatatttcttttcatataatttcatttttgtatgctaaaatgtgaattaaatgtgatgaaatactgtaaaattactcattttggcaaaaacctttgttttattcatctgtcttgaagattttttaaaaatagcaattaacttggaatgccgatttataaatatgtatatataacctttctcaaaaagggaaaggtaagaagaaatgttatatatatttatttatttcttcttacctttccctttttgagagatctcttagtaatagtcaaagccataccctattccttagtgagaaagccagtttgaaacgaatgtagcaatagatgtaaaaacatttaaaggcgttttaatgtggctttttaatgagctggcttatgcctgtagtcccagcacattgagcagctgagctgggaggatcgcttgagcccaggagttcaagactagccagggcaacatagtgagaccccatctctatttaaaaaaaaatgtttttaaagataaggaacagacttaaagtgatgattgattgctcatagaacgttcattttgggctccagaactaggaatgatgtagaatttattgttgtgtcattgtctcattaaatgctgtagtttcctatgtccttgcctaccttctttcctcagagcctcgcatctgaccctcagagagtagcagttggattattccattataccaaggttggcaagcttttgctgtaaatggccagatagtaaatattttaggctttgtgggccatatggtttctggtgcaactattgtaacacaaaagaagccataggcaatatgtaaatgagtgagtgtggctgtattccagtgaaacttaatttacaaaaacaggcagcaggccagatttggcctgcaggccgtcatttcattccacaaactctctcagtcacatctgcgcacctgctagcatctttatttatcctcccctctagttactatagatggatcatgtttgctcctttctaagttcacctcttcagctcgttcactagattccgtccgttctaacctgaaggacttcactgctgcatttctttcctatcctttatcatcaatttttttatttttactagatcattttaataagcgtgcagtcatactgtaattcctcccacctttaaaaaacaaaaaataaattgaaacaaaacaaaacaactcctttatcttaaaactccttgaaagagttgtctgcactgcatcactacttcctctcttcccattttgccttacatccaagcttgtcagcctttctcctctaaaactccactgaaactgttctaatccatggtaccagtgatcttcacattaagtctagttagtcatcttcttacttgacagagttgttcaatcccttatccagtaaacattttcttcattttgctttgaggataccacattcttgatttaccttaactcttattggtcatttcttttctgtctcacttgctggttctttttaatctctttctgttggatgtgttatagaatcttgaggctcaggccttggactgctctttttgtttattccccctggtgatttcatcctgctccaagtacttgaaagtacatatgtacatatacacacaccgataactccccaaatttcatcatccacctagccctctgtattctatatccagccacacagtccacatttcctcttggatgtcaaatagacatctcagatattacatgcctaaaatggaacttttgataaactttcctattactttaacaatcttttatatctcggtgaatagcaactcagttctttccaatgctgtcagaacttctagagttatccttgacatgtctctttctttcagagaaagcatatcaggatatcttgtaggtgctagcttcaaaatatattcaatctgaccatgcctcattgtctcagccaaaccaccatcaactcttacttggataattgtactgtgtagtctttgtctttactcttaatccctcctgaatactctgttcttagcatagcagcccaagtgatagaagtaattcgactcatggtaattctctgcccacaatgct

SEQ ID NO: 5920 - DNA, 1680 bp, Homo sapiens
atacccggatggaagtgtaatggccgccatcagggactcgcaggcaatggagatgccctgctccctgacgcgctcgctcttctccagagttggccaaaggtgctcttccccgcagaccctaaccacacccagtggcagttggatttctttgtaactggctttctcacatgtagggttcattttgactctattcgttacatggtgtcctctttgtcaagtagacagtctcttcctaggtggctgtggtaattgaaaagtacatagagcgaaatgtatataaggaaaaatgttttaactcttaagtggaccgatcaaacagatgtagctttaaagttcagaatacaacagttaagactcagttttctttttaggtttaaatttgagagcaagtagtgtatgtgagctgttttagtgcaaacattgttgagtatgttgtcaaacgtctaaaaaaccctagaaaaataaaataagtcaatgttcaaggaattcataagaatgttggaatttgtacagttgtcgcagtgataaaacatgaagacaccaaactgtcaggataggaattctattaacttgaaagtgtgcatgttagatctagttactggtaattgttgaattgctttttctgcagcaaggggtctgatttgagtgtactctaaggttgatatcctcaggtttaatttaaaacatttaaattgattcagtgaaatttcctaacattttttgagtttaactgcaaatttatagaaatgcattcactatctttcagcaaaattgtcttttctgaaatttataaagagacattgcgttctgttaacactttgagggtgttgggatttcctggggaaggtaagcatagtaaacgatgttgatttttgccatagaaactgtaaattagatcatccctagatacagaaaattgccaacaaaaggggagaataaaatgtaggtatgttacacaaccaaatgtttcctgtttgttgcgtgaaaataagtataattaccaaataaaacgttttatatctggttttatggaaggacaaaagacagtaaccacaatgaacacccactgtgtgcattgataatgtatgaacttttaaatgcttcaattttttgccatggtcacacttcggattctgttctagtctctctggtaatagtatgctgtaatcccagaagtttctatattttgaaatattacagagggactatactttagcctagatctataatttgacttcaggatatgctttaaatgccctttaagtgtatttttgttgtttacttttctgtttatagttgtttagaattgttctcattgaggcattgtgacattgcatactttagagcacttaatactactttttttttttttctttaaatgataggagacttgaatcttgcccacattccttcaggtatgctactgaaggttttgtggcaaagtgctattagcagaacaaaaaggttttaacaccgtcttgaaatttttatttattatctggtcccaggtgtgtaggctgtgagtatttcagttctatatggggtattggcttctcatggtgagcagttttcatggcatattagataccagaaatgagtattaagggttagtattgtggtggtaggataactgaattggaaccggatccagatattatttctagttttgtgactttgggc

SEQ ID NO: 5921 - DNA, 4734 bp, Homo sapiens
ctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctcctaatgttgtatatttaatttgtcctttgtccaagaataatgcaatgaactaggcaactagttgaataaaaattgaaaccaagttcaaacaagcctattgaaaaatgggcaaaagactggaaaaacatggccaataagcgtaagaagagatgttcagcttgatcagtcatcaagaaactacaaatcaagaccacactgaggctgggtgtggtggctcatgcctgtaatcccagcactttgggaggctgaagtgggcaaatcacttggacaggagttcaagaccagcctgggcaacatggtgaaaccctgtctctactaaaaatacaaaaagttagctgggcatggtggtacacacctgtaatccctgttactcgggggctgaggcacaagaatcacttgaactctggagagagaggttgcagtgagccgacatcagccactgcactcaagactctcgatctctctctctcaaaaaaaaaaaaaaaagaccacaatgaaatacaactttggactcagtagactgacaaaaattaacaaatgttacacagaatctcttatattgctggtaggagtataaattgtttcaattatttttgaaactaagggtttgcattatcttgtgaagtttaagatagattcacatatatgctcaagcagcaattccacctctgggtatttacctaaaggaaatgatagcatgaatgccccaggagacatggtcattaaagttcttagtagaactgctcacaatagcaacaacaaaccaaatgcccattgacgagagtggatgaataaattacagtgaaatattttgcagtcaaaattaacagataaatccaatatgacttaacagtggtttacagcgaatgttttgtttctctgctgacacatcaatacttgtgtcttcatatgtttagcatttttattctgaacttatatgtggttgaaggtcatctgtgggagtcagaaactaaattgagcatgctgcctccagagagaattagcatttgcttgtttttttcgggtaacatactgctatggactggggccactttagccctgtttgagtatcctaggctattagtagagtcaacttttacttcttacagcttattcccaaggcttattctccagtgtaaccctagatttattttttattatttttatcttttttaagattcaagggatacacatgcaggtttgttacatgagtattgcataatgctgaggttcaggcttctgatgaccccatcacccaagtagcaaacatagtacccgataggtagttttttagtttttcaacccttgccccactccctcccttcccatgaatccccagtgttagaaatgcttgttccccagtgccgtaaagaaatagcacttgaacataaatttaatttcttcagcaaggccatttttactttctgcagaaagggtacactcactagcagttttgtcaccagagtacacagaacaaaggagacagggtcatttataacctgatgcgtccacactactgctgtgtctgatttccactggctggaacgggacctcacattctgtatttgtcctgattggctagcaacttagaaccttttaaaagaggcaaaggcagaggagaacaaaggaaggaggaagtaacttgtggaatgctgagaaaggtaaaaacaccttcaaataaggaagaggaacaggctatgacctaatgcttgcttggaccagtataagcatgccagggcaaatatttaggctaaattgtgggagataacataaagtacattgatttctttattacagatagcagatatttaagaatgttggcacaggtctttgaataaattttgcttctaaggaaagttactgtttattcctaattagatggggaagaaagtctttgaagaggaacgtctactttttttttttacaccagtgtctattgttcctatctttgtgtccatgtgtacacaatgttgagttccaacttacaagtgaggacatgcagtatttgtttttctatttctgcattaatttgattaggctaatggcctccagctacatccatgttgctgcaaaggacaggatttcattctttttaatggctgtatagtattccgtggtgtatatgtaccacattttctttatctagtccaccattgatgggtacctgggttgattccatgcctttgctattgtgaatggtgttgtggtaaacatgagtgcaggtgtctttttggtagaacgatttattttcctctgagtatatacccagtatgggattgctgggtaaataataattccatttttagctctttgagaaatctccaaacagctttccacataggctgaactaatttgcattcccaccaacagtgtgtaattgttcccatttctcaaccctggaagggttattcagatagtgtttgccagactgctggaagtgtatttcactaactatagtttgattcatatgtcttccgtgacttatctgtaaattccttgaaagaaggaacttctgacctaaaattttgaataaaacattaaagttttagggaaatttggctgggtgcagtagctcatgcctgtaatctcagcactttgggaggccaaggtgggaggattgcttgagcccagaagttcaagaacagcatgggcaacatagtgagaccgccatctcaaaaataacaaataaaataaagttttggggaaaattcttatatatttagatactatggtaacgttttaataaaataaactgagttgcttttcatgtatttctgttttctaaaaattatgtgctatattaattacctgttcctgccctggagatgatgtttggttatattttcaggttctttcactatttttatttttgtctgtttggacttacaacttttatctatgttaaatctggtatttatacttccctttaaagccatatattttatcaaaaaattattagagaaaatttatactcacatggtattttctaatattaaaaactccttaaaaaaactcatgtctgtcaccttgctcatttcctttttttattttttgagacagagtttccctattgtcacccaggatggagctgcagtgagccactgcactctagcctgggtgacaaggcaagaccctgtctcaaaaattaaattaattaaataacaccataatttatgggtgtgtatttatttatagctttagccacatataaactcttaaaatgttatagtgtattttattacttctaagtaacctatgattttatttttacttcatcttaactcacttattgaagaggttaatattttaggtagttgaaatgttttcctgttttaattgtcagtattaatttctagttataaatttggactaaagaatgtgacctgagcaatttcttcattttggatattactgaagttttatttgtgaccaatatttgaaaccatttcatggttcctgaacaagaaagcatggtatgtgcttcaaaatacaacattcaacttatagctgtattcagtgttgttaattgtattttgaaagtaaaaactaaccattggtttttgtctacctgatatatatgtgcctgatagtatcttgttgtcccctgctatgtttttgtttctgtcaatgtatcatattttaaatcatagttattttataaaatgtgattgtgagttattatttaaaccatgccttctttagaggttggaccttttatcagtgtgaataactctttttgtcccttggatatcaattaaattgaattctaatttttttttttaaccttacctcaggtgctgtttggctcctgcagccaaatacactgatgatttaattaaaatgtttatctcccccaaattttaagaactttatttgggttatttggaataatgtataaaatatctatatagattattatataattcagggggaagcaaattatcagaacaatttcatgttatacaaataacatcagaaaaatatcttaaattatatggcatattctattgattcatccacaaatttataagtccttaccacctttcattatattggtactaggcattatagtagtgctaggcactatagtaatgctggggtataaacaagaataaaacaaaataagttccttatttcaggtaacttacagtataggtcagtggttcttagcttgctttttaattatgaattcctttgaaagtctagtaaaataatccaacaccattattccccattgcacatacccccagatgttttagacatattttcaattgctccatggaccttaagaaaacttggttggtgtgcagtttggtgtattatgggtaagactggacctggtgttagaaaatctgcatttgaggctttgttctgacagtgtctagtgtaaacatgggcagaccacttaaacctctctttagtcttctctgtagaatgatgataataccatctaattagcaggattgttgttttattcagtgagacagcatatgtaaataacttagtaaaataaaaagcaacgtgtttataa

SEQ ID NO: 5922 - DNA, 2477 bp, Homo sapiens
agtacatgattccccagcttcaataatggactaatgacccccggaatcccaccgctatagcctgcacttccccaggaattcctgtttaaggcgtctctcaatgaagaccacaaacaggaaatggaggagtggggagttgcctgacatcctggaaactacgttcttaaagaactgcaggcaatgggcgagagttctaatacatggaacagttacaggacactaagttctagagcaattcatctccagaacaaaaactgaaatggaagcaagaaaaaaataagtttctcacaactccttccgtgttgtacaagccccagtccagcacaatactctgccctaatcactctgccctccatccatcctctccagcagagtcaatctctaagtggttccgagctagttcactgaccacagaggacttcttcaaaatgtccttctaagatggctactgagaagtttggaagatggcaagaaaagtgcctctgaaacagtgactccaaaattgactgccaagtcaacagaaaatgttgaattgtttcctaatcaatctcatatgacctccataagaacagggataatacttatataatacctattcagatacagataccaaaatattattaagagaacaggtgaagagtggcttaattcacaccattaacatgtaaacatgttacatgttacaaacatgctcctcatgtaatccttatactaaagtttgagatttactggtatcaacagacatttaaggctaggaactgactgtaccaagatgttagaagtttaagtaatactgaccccccaactagatggtctaagtctcagacaatgacatttaaaaggacatttggttagaaataaaatctggaatccacagataatggcagatggtaccttggacttaaaagataccatttcagtctatatgtttctagaaaagagtaatacaggcacacactaaagctgggatggctagaaagaggctctaaaaatgagactagctggggataattaggagttaacatatgacacaaagggttgactttgaccgtgaaaatctttctgcaccagcatattctatccaagttagaccaggggaattccctgaagaaatggattcagtatgttatctcaagctagttatccatatataatgtgggtaggttctattatgcgcttaaagtagtttttcagcagaaactgagacagagatgggattatgagtgtgtatataatgaggctacaatgagctaccaagctgataaaatacaaacctctctttgagccctctcaaaggaaggctatgctttcatgaaggtatcagactaaagaacaaaaacctttccagcctctggaccccaaaaagaacacgaatattgctactattgaaaatactagctgcaacaggacaagatccttttgtaaaagggcaagctgtagctttctgcataatttaactgctgatcagtcctccaaataaatttcctgacaggtagagggcagtatactaatcagcttgtatttggaaaggacagaggttgcctctctctaacgtgatgacatcactaccaaacgcaacaatgacacatctaaaataaaagggatccatgtgccatctggtggctgaaagcagtaaagcacactgctagaaataaaatatcaaattcccacggttgagaagaaaattaaaacttaattcctttacctgatgatgcagtcccttaaatctccaatagtaagtcttctgtggaaactacatcagcagccttcgcgcaatagttttaaagttttgccccagtttagctctatactcctaaacactggctgtaagcaagcagcagctcctgatgcctgacctttggtgcatagagtaagagaatgaaactcagaccaaaacaaacaaaataacaaaaggacctggaaggctgtcagaaacaaaagaagagtttgacatgacagataacaccaaagacagcttattgcaaggaaaaaaagtaacagaaccagaagtttaaaactgaaagataccttttaggttcatgtatctcactttacagatagagtcaaggtaagaaagataacccctggtgcaatcttattagtggtcagactaaaacaacatatcacttttcccctactagacattaccataaatatttttttatttttcgtggaagtataaattgctacaatcttatacctagcaacttgggcccacagattttatttttaagaatttactgtgcagaaatacaagtttgcaaagacaattaaaaatggatgtttccttcagcattgcttgtaataaaaaaatggaaaacttatttgtattatatgacagaatacaactatcagaaataatgacacaaatctatatgtaaggacatcgagatgctaaaacacgttaagcaaaatacaaaacagtatatactgtataagatcacaccaattatattaaaaaagaagtgtgtatacct

SEQ ID NO: 5923 - DNA, 2480 bp, Homo sapiens
agtacatgattccccagcttcaataatggactaatgacccccggaatcccaccgctatagcctgcacttccccaggaattcctgtttaaggcgtctctcaatgaagaccacaaacaggaaatggaggagtggggagttgcctgacatcctggaaactacgttcttaaagaactgcaggcaatgggcgagagttctaatacatggaacagttacaggacactaagttctagagcaattcatctccagaacaaaaactgaaatggaagcaagaaaaaaataagtttctcacaactccttccgtgttgtacaagccccagtccagcacaatactctgccctaatcactctgccctccatccatcctctccagcagagtcaatctctaagtggttccgagctagttcactgaccacagaggacttcttcaaaatgtccttctaagatggctactgagaagtttggaagatggcaagaaaagtgcctctgaaacagtgactccaaaattgactgccaagtcaacagaaaatgttgaattgtttcctaatcaatctcatatgacctccataagaacagggataatacttatataatacctattcagatacagataccaaaatattattaagagaacaggtgaagagtggcttaattcacaccattaacatgtaaacatgttacatgttacaaacatgctcctcatgtaatccttatactaaagtttgagatttactggtatcaacagacatttaaggctaggaactgactgtaccaagatgttagaagtttaagtaatactgaccccccaactagatggtctaagtctcagacaatgacatttaaaaggacatttggttagaaataaaatctggaatccacagataatggcagatggtaccttggacttaaaagataccatttcagtctatatgtttctagaaaagagtaatacaggcacacactaaagctgggatggctagaaagaggctctaaaaatgagactagctggggataattaggagttaacatatgacacaaagggttgactttgaccgtgaaaatctttctgcaccagcatattctatccaagttagaccaggggaattccctgaagaaatggattcagtatgttatctcaagctagttatccatatataatgtgggtaggttctattatgcgcttaaagtagtttttcagcagaaactgagacagagatgggattatgagtgtgtatataatgaggctacaatgagctaccaagctgataaaatacaaacctctctttgagccctctcaaaggaaggctatgctttcatgaaggtatcagactaaagaacaaaaacctttccagcctctggaccccaaaaagaacacgaatattgctactattgaaaatactagctgcaacaggacaagatccttttgtaaaagggcaagctgtagctttctgcataatttaactgctgatcagtcctccaaataaatttcctgacaggtagagggcagtatactaatcagcttgtatttggaaaggacagaggttgcctctctctaacgtgatgacatcactaccaaacgcaacaatgacacatctaaaataaaagggatccatgtgccatctggtggctgaaagcagtaaagcacactgctagaaataaaatatcaaattcccacggttgagaagaaaattaaaacttaattcctttacctgatgatgcagtcccttaaatctccaatagtaagtcttctgtggaaactacatcagcagccttcgcgcaatagttttaaagttttgccccagtttagctctatactcctaaacactggctgtaagcaagcagcagctcctgatgcctgacctttggtgcatagagtaagagaatgaaactcagaccaaaacaaacaaaataacaaaaggacctggaaggctgtcagaaacaaaagaagagtttgacatgacagataacaccaaagacagcttattgcaaggaaaaaaagtaacagaaccagaagtttaaaactgaaagataccttttaggttcatgtatctcactttacagatagagtcaaggtaagaaagataacccctggtgcaatcttattagtggtcagactaaaacaacatatcacttttcccctactagacattaccataaatatttttttatttttcgtggaagtataaattgctacaatcttatacctagcaacttgggcccacagattttatttttaagaatttactgtgcagaaatacaagtttgcaaagacaattaaaaatggatgtttccttcagcattgcttgtaataaaaaaatggaaaacttatttgtattatatgacagaatacaactatcagaaataatgacacaaatctatatgtaaggacatcgagatgctaaaacacgttaagcaaaatacaaaacagtatatactgtataagatcacaccaattatattaaaaaagaagtgtgtataccttca

SEQ ID NO: 5924 - DNA, 2466 bp, Homo sapiens
aaaggagtctgttttaaaattgcctattatcctattccagggaaaactattaacattttgccatatttcattttatcagtcttttcctatgtatttttgaacacagctcaaatattactctatataaagacttgtattcagctttttcaacataaattacattaaagttatttttatgtcaataaaaattatctttgtaaacaaaattttaatggcaaaataacatttcatcatatagacatactgtaatttatttaaacactctcctaaaatcaaatatttagttaggagaaagttagtaggtcaaagcatataaacattgcgcaggtcactgtggcctaaaaaggctgttcttttttattttttttggaacagagtctcgtactgttgcccagcctggagtgcaggggtgcaatctcggctcactgcaacctctgccccctgggttcaagcaattctgccccaacctcctgagtagctgggtttacaggcacaggccaccatgctcggctaatttttgtatttttagtagagacagggtttcaccttattggccaggctggtctcgaactcctgacctcaagtgatccacccgcctcggcctcccaaagtgctgaggtgggtggatcacctgaggtcaggggtttgagaccagcctggccaacatggcgaaacctcatttctactaaaaaatacacaattagccgggcgtggtggcgggtgcctgtaatcccagctactcaggaggctgaggcaggatccacctgaacctgtgaggcggaggttgcactgagccaagatggtaccactgcactccagcctgggcgacagagtgggactccatttcaaaaatatatatatatatggaggaattaagggggtacaagaattctaaaatatacaaatcatcaggctcaaggaatgtcccttgcacatcatgtggtttcccaactcctcaatccactgttatcaaaggtctaatggaaggcaaagggagccacacactgctcatctctattacgcaacccctcaacccccgctggctctcagggaagggaatgggttcagtttgttcagcaaacattgactgagtgttgtctacttctgagcgcctggctggcattaccctaggtgctgcatctgccctgtgggctccagctaacaggctggcaagagagacctgcatgtaaaataaagggaaattgccacaagagggagttgagaggtcaccatggaaaggcaggaaagttcaactggcccaggacaggcttcaaggacaaaacactaaggctctccttaaggcaatagagagctggtgcaggaaaagactcagcaggagtcattgcaatgctatttgaataagtgatggagtgggcctgagggaagagggagttagggaaggtcacacaggaggaggcctgcctggggacaaagggatctaggcaattgtctcctgaagcgctctcagccaggtttatggttagaaagctaaagtactctgtgctatctcccaatcaacaaaccctagtggctccacacccacattaataaaggcacaaactctcctatgtatacaatcttttctctgcttctagactgtactctcctgggtggagagaactaagtcttttccttcattaagtaaactaatagaaaacagggacccctcaaatgttagtttccatcttcttgattgtcctctcccctcccccagggacttgcacagaggcattacataaacatttgttaaatcaatcaatgatttgcaggtactggaaaaaatgctgcattctacttacatttgatttgcatcaaccaagaatctgtagtaatgataatagatttgcaaagggtgtttttccttctcatttattatcttatttgaccttcacaatagtattagaaattagcctaaataggtatttattcattcttgttttcaagatgaggattcttagctgaaagaaggtgaactaattgtccaaaattacaaaggtgacatgggaacaagcctagatcactgactttctgactttaggctacctcttccactgcatcacaggtccgtgtggcatttctcactatttctcatcattgacaaaaattaactgcagctaagataaagacagaaactgaaaatatacaaccataagaatacaagaagggggggtgaggggcgggcacagtggctcaagcctgtaatcccagcacttgggaggccgaggcaggtggatcacctgaggtcacctgaggtcaggagttcgagaccagcctgaccaacatggtgaaaccccgtctctactaaaaatacaaaaattagccgggtgtggtggtgcatgcctgtaatcccagctacttgggaggctgaggcagaagaatcgcttgaacccgggaggcagaggttgcagtgagccaagatcgcaccattgcattccagcctgggcagcaagagcaaaattccatctc

SEQ ID NO: 5925 - DNA, 9099 bp, Homo sapiens
attggcagttggcccttcagctgctgtacagcctcggtaggggcccaggggtattgaatctggttttggaccacaggaggagagtgaagtgaagtacaaccaatattgtcaacagcaagatcgtcaagcctccctgttccctgcagcatagcaatattaaaattaggccaatgaaaaaacctacaatgacctctaagtggttcaagtcaaagaaagaggtgcatgcctcttttcctttaaatcaaatcaaaagcagaacaggattgagcttagtgaggaaggcatattgaaagccaagatgggccaaaagctaggttgcttgtgccaaagaattagccaagttgtgaatgcaaaggagaaaagttcttgaaggaaattaaaagtgctactccagtgaacacatgaatgataagaaagcaaaacagacttcttgatgatatgaagaaaatttgagtgggctcgatagaagatcaaagcagccacaacattcccttaagccaaagcataatccatagcaggaccctaactctcttcaattgcaatgaatgctgagagaggtgagaaagttgcagaagaaaagtttgaagctagcagaggttgcttcatgaggttttaaaaagaaagctgtctctacaatgtaaaagtggaaggtgaagcagcaagtgctgatgtagaagatgcagcaagttatccagaagacctagctaacatacttgatgatggtggttacactaaacaataaattttaaatggagatgaaacgtgttatgttagaagatactattgagaactctcatagctagacaagagaagtcaatgcctagcttcacagcttcaaaggacaggctggctctctttgttaggggttaatgcagctggtgactttaagttgaagccagtgctcatttaccattccaaaaatcctagggcccttccaaattatgttaaatctaatctgcctgtgttccataaattcaacaacaaagcctggatgacagcatatctgttcgtagcatggtttacagaatgttgaagccctctgttgagtcctactgctcagagaagcagatcactgtcaatgtattaccgctctaatggaggtgtacaaggagaccaatgttgctttcatgcctgctaacacaatatacattctgcagcccatggatcaaggagtaattttcactttcaagtctgattatttaagaaatacattttataaggctatggctgccatagagaatgagccctctgatgaatgtgggcgaagtaaattgaaagccttattgaaaggatttaccatcctagatgccattaagaacattcatgattcataggcagaagggcaaaatagcaacattaacaggagcttggaagaggttgattccaattctcatggatgactttgaggagttaagacttcagtggaggaagtgactgtagatgtggtggaactagcaagagaactaaaactagaagtagagcctgaagataaatgactaatttgctcaaatctcatgacaaaactttaatggttgagaaagaaagtggtttcttgagatggaatctcccctggtgaagatactgtgaaaactgtggaaataacaacaaatgatttagaatattacatacacttggttgataaagcagtggcagagtttgagaggattgactcccattttgaaagcagttctactgtgggtaaaatgctatcaagcggcactgcacgctagagcaattttttgtgaaaggaagggcccatgatgtggcaaatctatttgttgtcttattttaagtaattgtcacaattaccccaaccttcagcaaccccccaccctgatcagtcagcgaccattaacatggaggcaagaccctccaccagcgaaaagattatgactcactgaagtctcagataaccattagcatttttagcactaacgcattttaaaatcaaggcctgtacattgttttcgtaaacataacgctattgcatacttaatggactacagtatagtataaacgtacctcttatatgcactgggaaaccaaaaaattcgtatgactcactttgttgcaatattcactttattggggtagtctgaaattgaccccacaatctctctgaggtatgcctgtaagttttgataaatgtaggccctcacataaccaacagtagtcgagttacaggacatttttctcaccctgaaatttcctgcatacatctttccagtcaatctccatctccctcatatgcaactattgttctgattttagtcatagattaatttcacttattcttgaatgttttataaacggaataatgtaggtatatactcttttgtgtctggattctttagctcaagaaaaaattttaacgattcatccatattgtagtcaatagaggcagttccttatttttgagtgctctgtgtaatttgttgacaaatctcccttttgatgagcttatgagtcatttttcagtttttggctatgaggaaaaaagcttgtggattctggtacaagtcattttggttgacaaatgttttcattgctcttgagtatacaattaggagaaggattttggggtcatggattaggagcatgttcaatttttaagacacttacaaatgcttttctaaaatgattgtaccattttatactctcatcagcaatgtacaagagttccagttgctcattattttcaccaatatttcacattaatagtctttttaattttagcctttttggtgggtataaactcatatcccattgggattttaatttttatccactggtgacttttaatatcaagaaacttttcatgtgttcatcgatcatttgtgtatcttctttctgaaggactattattcttttccccatttgtatagggttgtttgactttgtcttatgaatttgcaggagttgtttatatatatatatatatatatatatacacacacacacacacacacacacacacacacacacaatataaggcctttatcagatatttgtgctatgaacattttctcccaacttaaggcttgccttttcattttttttaatggtgactttgtaaaatccaatttatatttttacattaagattgtggtaggccgggtgtggtggctcacacctgtaatcccagcactttgggatgccaaggcaggtatatcactggaggtcaggggttcgagaccagcctggccaacatgatgaaaccctgtctctactaaaaatataaaaattggctgggcgtggtggcacactcctgtaatcccagctacttggtaggctgaggaaggagaattgcttgaacccaggaggcggaggttgcagtgagccgagctcatgctactgcactctagcctgggtgacagagtgagactccgtctaaaaaaaagattgtgttatgcccataaacgtgctttctgtgtctctgcgtacttcttaggtctcaaaggtagtctacactctgtttgttttctagatgctatatagaattgaatattacctttaagtaatctcaaacgctgtatatgttgtaaagtaagaatcaaggttttcttttttttaatttattaccaatattgaatcttccccatgctgtagcatcaagtgtgcccaggtggaaagctggcacaatcatggggctcgtattgtgtggttcccttttcttaatttttctgtataattcttaatgcctcttatattgtgtccaatttcatagctctttagaataggagggaaagtttattagcagacactctattatggagagaagtaaatacttcctttctgacatatttttttaactcaacttttcagtaattcttgaaagtacaggaatgcaaaattgttgtgtctcagtaacttcttgatttgcttgcttattcaaactatagtttcaatcaactctaaattatgtgctttaccattgtctttggatatctctaccatcggcaaagcaaataatgtggaaattcattttatttaacttattctcaaactagagtgtgacaaggttccaaggcaagtggaggaaggcccagtctcatactggactgtctttttgggccagacttccattttacatgtatcagtggacctgagtttagtttctgccactttttattaaattgaaccagtttaactcgagtgcggttttgctaaattttggaatcaaaatttatcacagatattatgtgataaaatgtatcacaaaatatctgtagtgacatccattagttaacatcatttgagttttctattatgcgtttatgggcatttgtctcatagttgggctctttacatccatgaattgtgatagttctttgtattctaacaatgagccactttatgggtttttgtctgtcatttatgtgtgtttttatgttccacttagattttttttcatatctgagaacctcagtttacactgaagcccacctcagataagtctgcctaatactatatctcagtgctttacttttaccagaccttaatgactctctctatattttatacctctcttgaagtgaaaatctaccaatttgttccaaataatgtaattcatctacctttatgtaggtaaaatattctttttattaaagcaggcatgacaggacctaagttataattactgatatgtttctaaaatttattaacaatgggcatttcatagcaccaagtacacactatttgtctgttttatacataaaaccttctgtaaagttcctattatggaacctgaatagatcaagaatgacaattctcttatcttcagcttataagaggatagtgcaggctggaattcacattaagcaactgttatgaagctacctatatggatatgctacattatatttaaaggaatacataaagacaatcaaaaactttacaaataatgtgttaggagacagttgaatatgctgcataatgacatctttaaagattatacagagatagatagggataaatgatgggtaactggatttcatgaaagtacctccagcaaaacgaactgaaggtacagtacagctgtaggtcatttttcatgttcaataataatgacccaactaaagatcattcctgaagtaaatgcaatgactttttttgccactatttgtttaattggacacctataagtgtgttatttgcttaatcacactaaaattttgcaaagataaaacaatatctaaaataatctcatctaagatgtccataaagatgaagttctttagtcaaatcaataatccttcacttttctcaccaaaggcaaaattatctcctaaatcaagaatgatgcactttagctaactcctctgatgtgtcaaaaagagccattgctcatgacagattctaaggagctactcttccaggcagccactcaagtagaaatactcagagtactatacatgcatacctagaagcaaatcccccagcgatataaaaaaaaaactaattaaaaaagcctaacttttgaaccaccaaatcaaaataataattttgcaaaaggaccccttcaaaagaaaaccgaaagctgtgtcttcattgcattatattgcatgaaccttgttcatactaatgttcaattgttgttcaactagttacatagactatgttatttagctttctgacacatgattttctcagatggtatgccattagcagattttcttaaagaaaatataactatagaaaggaggtgtagtgtaatgaaagccagaagaacaaatgagtattcctgagagtactttttcagtaatttctgccaatagctttctttgtccttggcctgctgtttagcctcagttcagtgcatcaattcacctgctgattaaacagagataaagtgttcatgtttggaagcccacaatatgcaaagcaattattttccttaaaatatatacttagaaatagttttacatataaaacacagttttcctgtaaatttaacaggccagggcatgttctgttgcctgcagtggacctgatgatggaataagagacaatgaggacttgggtagatgttactggggtacaaaaagaaatttggtctaaggtggtagggtgggtttgaatggtgatgtgttcaccaccactggctgaacaaagagcaggatgccaacagaggcttctggtctccagtgacctatcgggtcccttactctgtcaggctgcgaacactctggaacatggggtatgctgctgtgaagaattggcacgggtgggcagagtgcacttaggtagatccctgatcttccgcatcctttgcactgcctttttgctgggcaaaagtctgagtcatcagtctcgctgatcttcaaacccagattttgtcatctggcctggctcaacctccaatataagatacatgttttacacagaaaatacgttgacaccaggaaaaaatacagtagcactagaaatacagagaaacaggtgaggtcttctcattatgaggggaataaaagtagaagatataaataaaggtggctgaaatgtggttgggagcagaagtgggtttgctcagaggatgttgagaagcagcaagagcttttctgtatggggtctgattcttagagttttcaagcctcttctgtctattccatggtaattcatggactgccacactggggctcaattcctccctggtgtctgaagtctgcctttaccttaagcactaatgggcatttaagaaactctagtctacatgccttgcacacacagcttgaacaggatgctacccttgttgcttgtgtcagcctaaacttaacttcagcatgatacactggacttccacttggtgcccttttgcctccattttggtgttctcagatcagatatatcctggctccctccatactggagccctgtggccatctccctgtccttcaggtctgagaactctcattttcccagactagcagaataccctgaggcaagtgttttgctggattataaaatatattttctaggatctgaatgtttgtgtttcctcaaaattcgtatgttgaaacctaattaggtaatgggattagtgcctttatgaaagaggccccagagagctgccttgccccttccagcattgtggggacacagctagaaggtgtcatctgtgaactaggaaatgtagttcaacaaaccatggctgttgctatcattaccttttaaaatttccacatggtacctatacttgtggctgtccttcaaaggtctgagccataacatgggaggtttagtttgttcattcattaattcattcaatctgctgtactctaggcactgttctaggcattagatctaagtttgtgctttcctcactgggttccatcttggtataggtaagtgattcatgtccaactatgcctcaaaataggagacatgggagaggtaatatagtacagtgggtaaggaagctggctttgacattacacaggtgaagtttgaacacaagcctttctactgggcagctgaataaggtaaataagttttctatacctgaaattttcttatctgaaaaatagagacaattatactatctatctcctagggttgctgtgaagtttaagtggatacttttagtgtgcttagattagcacctggtccataaatgctcaatcaatgttagctataattaaggttttaaggtttaagctcaggggtctgaggcctgatagtttagactttcaacctggttaccaattccaatgttaaaaaacaattaaaattctgattcttttatagagagaagactatttcttttaaattatattttacctctaaatgaatttaatttttctcccatccttcctctttgggaaatattattggaaccaaattttgtggtataaatcagaataattttgtggcctagatccttgattttatggagaattcttgaagagtttcattggaattgtctatgtatttagcttcagatggaaagctgaaattactcatcaaaggattgcaataagagtgatttgaaccacaagtatatcagaacttcaggcttctctaagacaagaaaataactgacagatgaactgcagaaaaagaaatggggtgacttatttagactgagatggtcatgtaggctgtataaaaaagaagagtcagataacaggcttgtcaaactagctaattgcacctgcaaacaaaggacatagtttaaagcatgggttttagaaaggaatgctagtctctcatttgtattttcagctggatctgcatacatgggtaggatcaccacaattgacgatgtcatctttgaatagggaggaatagagactcacacagagcttgcaccagggagattctacacacagatgaacaattcattagccattcagagctgaaagctgccgcctaactttgctctgtatgctgaaaacaatgcaatgatcaaaaaagaaaaaaaaaaaaagaaaatagaatcaaggcagtaaggtaaccctttaggaagtgatgggagtgttacatcaacatattgtcaagatccagataaatctgaatatctacacagtactttctatcctatgagatttgaaacttagacttcatttcagatttgcgaacagtgttacctagttcccattctaaaattactaaatctacaaaacatgcttcaaccctttctccttcaacttttttttttaaatgtttctctttttaaaaatatgtatttttaaaaaatatatttttatatatgtattttttgagacagggtcttgctctgtcacccaggctggagtgcagtggtgcaaacatagctcgctgcagcctcaacttcctgggttcaggtgatccttccatctcagcttcctgagtagatggcacaacaggcacatgccaccaagcctggctaatttttgtatttttggtagagagagtttcaccacgttgcctaggctggtttcaaactcctgagctcaagcaatccaccttggcttcctgaagtgctgggattacaggtgggagccaccgtgccctgccatcagtgtatttttttttctgaaattttataataagttatcacaaattatgataaattgcattttcccaaagattaaattaacaaacttcccttgagcactt

SEQ ID NO: 5926 - DNA, 611 bp, Homo sapiens
tatccctgcactacccccaatattgtgcatgtgaggttgatggttaacagcctcctgtgttaatcaactaagacaggggtgtcccatcttttggcttccctgggccacactggaagaattgtcttgggtgacacaaaatacgctaaggatagctgatgagctcaaaacaaaacagctcataatgttttaagaaaacttacaaatgtgtgttgggccacattcaaagctgttgtgggctctgggttggacaagcttgagctaggagaaactatccaaagaattcctaacctttatcctgtctctagtagctttaactggtacagcttgttttctgaaagtcttaattttctgcttttattcaagaaggttacttcacaatatgaaaataagattatgaaatgatgctaaaacagttatacatagttcctttttcatgttggtaaatgttttcttttgaagtgggaaacaatcttatttttaaccctggtttcagtcaaaagtaactatcctagtgtgaaatgatatcgccaggataaactatcttttgtgattatttttaaagcagaaatgccagtttctcttacctcagtaaaagttgattttatagcaaa

SEQ ID NO: 5927 - DNA, 424 bp, Homo sapiens
taaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacagaaactttgtctgcgaacactctttaatggacc

SEQ ID NO: 5928 - DNA, 770 bp, Homo sapiens
cagcattaaaacactcctggaatgtatttatttgaggagtagcaggaagaagaaagagaaggaagcaggctaggcgtggtggctcatgcctgtaatctcagcactttgggaggccgaggcaggcagatcacgaagtcaagagatcaagaccatcctggccaacatggtgaaactccatctctgctaaaaatacaaaaattagccgggcgtggtggcgcgcgcctgtaatcccagctactcaggaggctgaggcaggagaattgcttgaactctggaggcggaagttgcattgagccaagattgcaccactgcactccagcctgggtgacagagcgagactccatctcaaaaaaaaaaaagaaaaaaaagagaaaaaagaaagaaagagaagaagcagaggagaagagggaagaggagaagaaaccaactattctatagaaacaaaatgaaatctaaaattctatgcaaactttaaaaaataacttacctagtacagctgactcctggttcaatagtgaggaaatattggttggagaattcagtgataaagaatcatgtgaattgtaataagagaagagggatgtagaggatgttggcaacagagaagaaggaaaaacagttccatcttgcttctcaggtaaatcaagagacatcttagaactggtaccacttggaggccatgatgaaaaataaggattttccactaaaggaaattttcagtgcagccctatgcacacctgacgctctcaatttagttgtgacaatagata

SEQ ID NO: 5929 - DNA, 1820 bp, Homo sapiens
cttggacatggctttaccgagaaataaatgaattaataagcataaactctaggccatacttaggtcaaaataagtgaagttacagtgagctcctcagattcttctagaaagtaaacaacccatcaatctttaatactaagtcatctgaatatgaactagcatcctaaaagtgaaaagctctaatggtacattacaaattcctgagtcattttgtcctcacaactttatgctttaaataaaactggctaaagaaaatctacaagtgactcagtatgacttagtgtttccaaaccaggaaaaggaaggactttcagtgtttgagataaggtttttttctgtagtttggaaaataaacatttcctattcagttatgcccaggggcagggtgtgtgtgtgtatgtgtgtatgtgtgtgtgtgtaggggaaggagtgtctgtgtgagtatgaaaagagaagaagagcaggaacgagggagtaagacagggaaggagagagggagaagggagagaaagagagggaaaaggagaaaaagagatttttttaatcagtatttggtgttcacgtaaaatggttactttctgcaaaagttacctcagcaaattatgtgtaagcaagccatggaagcactgcaatttgtaataaaatcaatgggaatggcttacctgactgtatatagtagataatccttatctatggggaatacattccaagacccccagaggatgcctgaaaccatggacagtaacaacccctaaatatactattatttttcctatacatacctacaataaagtttaatttataaattaggcacagtaagtgattaacaacaataactataataaaacagaacaattatactgtaataaaagttatgtgaatatggtctctctcttggtttctctgtctcaaaatatcttatcgtgttgtaccatgggtaactgaaactgcagaaagtgaaattgcagataaggggggattactgtattgcattctgtactgcatttccatgaattcagtgacacacagtgatgtattccatgtcgttatagcaaataataatcttaggtgtctaaattagactgaattttttatttcaataggcataagccattttctgcacctaaatgaaagtagcattttttttcctgatataaaaatgggcagatttttgtcctggtgtcatgctaatataaccccagaggtggcaagcatagtggctcaagccagtaatcccaggactttgggaggctgagacaggaggatcacttgaagccaggagtttgagataaccccagaattatctactttatttaaagtacattttagctgggcagtggtgtgcatctgtagtcccagatacttgggaaagtaaggcagaaggatcgcttgaacccagaagtttgagaccaggcaggacaacacagattcagtctctaaataaataaaatacctaagaacactcagagtggctgaaaatgtgttcagcaaaatctgttccactaatgtccctaataacgtcagtagagactagggattaatgagactaccaataaacacacatacacacacatgaacatacacacaatgtttactatcttgttttctgttataaggattgctaaatatttttgtatgatatagacagttacaatttatattttttagagaattcatagaaataatccttaaaatatttagagattggtactcctttgacagataaataaatgcaaaagtgaaaattatttcaaaccaatagcacatatatcccatgatatccacaatggttttattttatccatcacttgaaagtaaaa

SEQ ID NO: 5930 - DNA, 645 bp, Homo sapiens
gaggtgggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagaactatttactgagctctacggagacacagctacaagcaccacatgctggacccctgaatatggagggccaactacactagaaacacacacgctagctgagaaagatggtggcttaaggggaaaaagaaagaaaggggagtagaaatagaagaaaagaaatgagaaggagaaaacaaaggagaaggaaaacgagaaaagaaaaatgtaggaaaaagttgtaagtgcttactacatgctgtgcccatattacacagagcgcacattttccagcttagtcttcacagaatgctgccagtgttatgatcctcattttaacaatgaagaaactgggagatttgttcaaagttacacactagtaaaaaagtaaatcttgagtgcaacataggt

SEQ ID NO: 5931 - DNA, 2646 bp, Homo sapiens
tcctgtcttctcattcttctcacttaaccattcattaaccaagtgctagagaaaagaaaaaaattggatcattatatatgtaattccaaattctcccttgaatattctaataccagatttgaaattggtgtattatctaaaatgataaattgggtaatttaaatcattcatatgtgatcaaaatatcagtatgtccttttacatttcttagttatctactgttattctgaaactttttacccaattattttgtagaacaaaacatatggttgctttttaaatatttatattacatgaaatttgtattacttttttttttgagacaagatatctctgtcatcaggctggagtgcagtggtgcagtctcggcttactgaagcctccgccccctgggctcaggtgtgatccctccacttcagcctcccgagtagctgggacaaggcgctcaccaccacgcctggctaatttttaaagtattttgcagagacaaggtccgctatattgcccaggctggtctcaacccctgggctcaagcagtcctcccgcctcagccttgcaaagtgctgagtttacaggtgtgagccaccgtgcccagccaagctttttaatatagttacaactagagacacgtcagtaccattttattaaacacactaaatttaggtttactaccgcttctattataggtataagatgttccatctgttagaaaaatctgattttaggcagtgttttcctacaatagctgcccatcagaatctcctggagatgaggacagtgcacagtactttttttgagaaagggtgagttgcccagcctggagtgcagtggcgtgatcatggctcactgtagcctcgacctcctgggctcaagtcatcctaccaccttagcctcccaactagctgggactacaggtgtgcaccaccatgcccagctaatttttttgtttttaattttctgtagagacagggtctcgttatgctgcccaggctggttttgaactcctgggctcaagtgatcctcccaccttaacctccccaaatgttgggattgcaggcataagccaccacacctggctcacgatacatatatatttaaaagtcaccattgacaatccctgatataaggggtttggaatatctcttaaggttcttgtgctttgaaatttttcatagtcattaattctgctgattctctgatctacaacatacataatacagtctctattggctatatgaatatacctgaccctgaagtataaattactactttaaaaaaaacgagtaaccattcatattgttacctagttagcaaatgatattttaatttccaagcgtaaatgtaacttatagaaaatatggccgggtgtggtggctcacgcctgtaatcacagcactttgggaggctgaggcaggtggatcacaaggtcaggagatggagaccatcctggccaacatggtgaaacctgtttctactaaaatacaaaaaaattagctggttttggtagtgcgcgcttgtagtccagctactcaggaggctgaggcaggagaagcacttgaacccgggaggcggagcttgcagtgagccgagatcacaccactgcactccagcgtgggcaacagagcgaaactccatctcaaaaaaaaaaaaaaaaaagaaaaagaaaatgtacagaacttagtatatataaatgtgcatatgtatatatatatacacacacacacacacacagaaacacacacattttaaaaatctacccatccttttttccaaaggtaaccactgtaaacattttagcatcttttctgtccctctctgtatatagaactccattcctaggactgcagtagtgaaacacatggagtctggagccagactgccaggagggtgaatcctggctttgccatttacactatgaccatgagcaagttaagtaacttttttatatctcaatctttatctgtaaaagaagggttgtgatagaacctagttctataaataggattgttatgaagattaaaagttcaataacatacataaagctcttagaacagtatctggcacagaaaaagtgacatgtattattaaactgaatgaggcctttaggggaaatcatgataatttggtactctgtcaaacagtatgttgtttaaaataacaaaatctgcaggcaaaagaggctttttaagagaatcagataggatgtagaagcctacatctcagaccagggatttaaataaatttatcgtaccacaactttgttaaaagtttaataaaaggtagggattatgtcatatttgtaattgagaaagtagtttcacttcttttaagcctgaggttttttcttttcactttacaaagttagaatttttttgtccattgttacaggcaaatattgggttgcttaagctatggcggtgcagtaaggagagtacagacttttaattagaaacaactgtgtttagattgtctctaatgaaacctgcgactttggcaagtaaattatttaacttgtgctattaaaatataatcctgggttcatactagaattttactaaatgtacatgtcatggtttagcagcatgcctacaaactgtactgaattaggtaagaacaaagacagaataaatgaaatttcaaagtaaa

SEQ ID NO: 5932 - DNA, 5320 bp, Homo sapiens
ccaggagacatacaatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaagctgaactagggccatgcctgggacagacagagaatggccttccagcagacatgccaagaagcaagccagggtcagtgagtgaagaggagggcaggcccatttgaagcaacacagtttatatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggtacttgtttccttctgtaattagagtttcaaatagactaaaagtttctgctcttaggtgggtctagagactctccagtacctcaggacctcaggacacatggggtctcttggttgttttcttttcattgttgttgtttattttatttttgtttttattttttaactttaaaacaattttttgtagatgaatatgcttacatatgtttgggggtttttttgagacagggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcactctgttggccagactggtcttgaaatcctgggctcgagcaattctcctgcctcggcctcgtaacgcgttaggattacaagcgtgaacaccgcacctggccagcatgtggtctcttaaccagaggaggcctcttctgaactaggtagaggtcctgagaattgattctgagagtaaaaggctctttgttctcctcagagtagattagaatccctaatgatagagcatctattattcctctagtggtccatgcccaacagattcatccaagaatagatgaagatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcctgagcctcagaggttgaggctgtagtgagccatgattgccccactacactccagcctggatgacagagtgagaccctgccttaaaaataataataatagtaataatatttcataaagatacaggaaactagattataattgacattttcaaagtgaaatactgtctagaatggtgcttggccaacagtaagctttttgtaagtggaagtcattactactactatttctttcattattattaccattactacttttttttacaaaaaaaaaaccctggacaacacactgaaaccattactacttctactactataacttaggttgcacctgatagagccagcaatttttccaaggtatgacaatggccatatgtttaatgatataattctatggctcagtgtatctcagcctttttaaaccctgctcttcttttgacaattgtaaaaatcttaaactgacctccagttgaaatcctctgtcaagaagatattgtcggccaggggcggtggctcacacctgtaatcccagcacttttggaggccgaggtgggaggatcacttgaggttaggagttcaagaccagcctggccaacatagtgaaaccccatctctactaaaaatacaaaaattaggcaggcatggtggtgtgtgcctgtaatcccagctactcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaagaagaaatcccaatctcttcttttatgtggattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccaatatggtgaaacctcgtctctactaaaaatacaaaaaattagccaggcttggtggcttgtacctgtaatcccagctactcaggaggctgaggcaggagaatagcttaaacctgggaggaagaggttgcagtgagccgagattgctcaattgcaccccagcctgggtgacagagcaaaactccatctcaaaaacaaacaaacgaacaaacctgatattttcaaaattgaggcaattataacagctatttagccaagcattatgatagcaataatagcaagaaaataaattagttaacaaatgagtctcagaagcccaatgatttttattttatttttattttttgaacttttattttagaatcaggggatacatgtgcaggtttgttacccgggtatattgcatgatgctgagttttggagtatgcatgaatccaacctgtcatccaggtagtgagtatagtacccaacagatagtttttttaacatttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaattagtttgacattagtttaacatctcaagtaaaacaaaataccattcaattaattctcttcttctacttttttcttttaagagagacaaatagtcacacatacatcagcaggagaggatacaatttcctgtgtttaagtttttatgagttactttagttcaaatgtcacagaaaattatattgaactcttgaccaatctatctattttttccattggagtattgacccaaataagaaatagcataaaggaaaaattattttttggcagaaaaatattctctctaaattcttgtgtgttttgttttgattttttccttagtgactggaggccagtttcaatccactgaagcacagattccaaattttcaatctggttttcttgagtagtgactgagtgccaaaaatgaagcaatgacacaacatcaccatcaagacactccccagcacgcacacacatgccagagtccaacaccaagatactccccagcacgcacacacacgccagagtccaggccatattcgggtggcttgcaagcttcttccccccaagtatttactctcaaaataatggtttttgttttgttttggtttggtttggtttgtttttttccaaatacatttcttccctatatctttaaccaattctcataaaattttgtctaatacactggtcagtgtattccagaccctaaaagataacataatgaaactatctatgactaaaaggtaatcaggatcttctacttatccttttttcctccctcttaaactttaattttgatacatttgggagtgaaatgatgacaataaatgcaaagtaattattgaagaaacagtaattttgtattagcttactgaaaaaaaaaaaaaagataaccaaatatattttggcagccccaaacgagtcacatgtgaaatgcagtgggagagcagtgtcctgaaggaaaaggtggcctgctggacagccaagagaacaaacatccactgcaagtaatatgagctctaagtttggactaggcctatgtctgctctgagacttggggcaattcacttaatcagagccttaatcagctacggactagcaatatccatacccgctacttattttgtaaatctcctttctaaagttaactctatttattgttccataatcccataaattctagaatcttttcctgttatagccaagttgtctatcattgacagagata

SEQ ID NO: 5933 - DNA, 7184 bp, Homo sapiens
aatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacaggtaaggtttggctaaaggatgaataagaacccctccttgtcttcaggagtttgtctagcagaggagtctgtcatgtaatcaggaaactccagtacacaacgtgatagctctaagacaggtatatacaagatgatgttctggaccttaactgtttggggagtactactgcctttgtctaaaagccatcaccctttttatatgccatttgggaggaactggggggacgtgggaggcttcaaagggttatgggaggatggacattttaaaagggcttttcttttctttttttttttttgagacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggtaattttttgcatttttagtagagacggggtttcaccgtgttagccaggatggtctcgttctcctgacctcatgattcacccgccttggccttccaaaatgctgggattacaggcgtgagccactgtgccctgccaaaggccttttcaaatctaacgatgtactcacatttccacctgtctgccagcccttgtccagtttgacctgggcactcactgctgctctggtggtgagtactgctgatggttcttttccctgcccatccttgaggtgctcgcttcaatatgtcaaatgaggactctcattacatttggctgtcatacatcagccacaactgtcctgcccagaagagctggccttggctttaaagcctacatcctggctgaccttctttactgctttattaaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaagctgaactagggccatgcctgggacagacagagaatggccttccagcagacatgccaagaagcaagccagggtcagtgagtgaagaggagggcaggcccatttgaagcaacacagtttatcaaggagtctttagcaacatgaaaacgaacgtgtgttatttgcaaaccaagtatatcattactgaacctgaatatccttactttttcataagatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggtacttgtttccttctgtaattagagtttcaaatagactaaaagtttctgctcttaggtgggtctagagactctccagtacctcaggacctcaggacacatggggtctcttggttgttttcttttcattgttgttgtttattttatttttgtttttattttttaactttaaaacaattttttgtagatgaatatgcttacatatgtttgggggtttttttgagacagggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcactctgttggccagactggtcttgaaatcctgggctcgagcaattctcctgcctcggcctcgtaacgcgttaggattacaagcgtgaacaccgcacctggccagcatgtggtctcttaaccagaggaggcctcttctgaactaggtagaggtcctgagaattgattctgagagtaaaaggctctttgttctcctcagagtagattagaatccctaatgatagagcatctattattcctctagtggtccatgcccaacagattcatccaagaatagatgaagatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcctgagcctcagaggttgaggctgtagtgagccatgattgccccactacactccagcctggatgacagagtgagaccctgccttaaaaataataataatagtaataatatttcataaagatacaggaaactagattataattgacattttcaaagtgaaatactgtctagaatggtgcttggccaacagtaagctttttgtaagtggaagtcattactactactatttctttcattattattaccattactacttttttttacaaaaaaaaaaccctggacaacacactgaaaccattactacttctactactataacttaggttgcacctgatagagccagcaatttttccaaggtatgacaatggccatatgtttaatgatataattctatggctcagtgtatctcagcctttttaaaccctgctcttcttttgacaattgtaaaaatcttaaactgacctccagttgaaatcctctgtcaagaagatattgtcggccaggggcggtggctcacacctgtaatcccagcacttttggaggccgaggtgggaggatcacttgaggttaggagttcaagaccagcctggccaacatagtgaaaccccatctctactaaaaatacaaaaattaggcaggcatggtggtgtgtgcctgtaatcccagctactcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaagaagaaatcccaatctcttcttttatgtggattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccaatatggtgaaacctcgtctctactaaaaatacaaaaaattagccaggcttggtggcttgtacctgtaatcccagctactcaggaggctgaggcaggagaatagcttaaacctgggaggaagaggttgcagtgagccgagattgctcaattgcaccccagcctgggtgacagagcaaaactccatctcaaaaacaaacaaacgaacaaacctgatattttcaaaattgaggcaattataacagctatttagccaagcattatgatagcaataatagcaagaaaataaattagttaacaaatgagtctcagaagcccaatgatttttattttatttttattttttgaacttttattttagaatcaggggatacatgtgcaggtttgttacccgggtatattgcatgatgctgagttttggagtatgcatgaatccaacctgtcatccaggtagtgagtatagtacccaacagatagtttttttaacatttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaattagtttgacattagtttaacatctcaagtaaaacaaaataccattcaattaattctcttcttctacttttttcttttaagagagacaaatagtcacacatacatcagcaggagaggatacaatttcctgtgtttaagtttttatgagttactttagttcaaatgtcacagaaaattatattgaactcttgaccaatctatctattttttccattggagtattgacccaaataagaaatagcataaaggaaaaattattttttggcagaaaaatattctctctaaattcttgtgtgttttgttttgattttttccttagtgactggaggccagtttcaatccactgaagcacagattccaaattttcaatctggttttcttgagtagtgactgagtgccaaaaatgaagcaatgacacaacatcaccatcaagacactccccagcacgcacacacatgccagagtccaacaccaagatactccccagcacgcacacacacgccagagtccaggccatattcgggtggcttgcaagcttcttccccccaagtatttactctcaaaataatggtttttgttttgttttggtttggtttggtttgtttttttccaaatacatttcttccctatatctttaaccaattctcataaaattttgtctaatacactggtcagtgtattccagaccctaaaagataacataatgaaactatctatgactaaaaggtaatcaggatcttctacttatccttttttcctccctcttaaactttaattttgatacatttgggagtgaaatgatgacaataaatgcaaagtaattattgaagaaacagtaattttgtattagcttactgaaaaaaaaaaaaaagataaccaaatatattttggcagccccaaacgagtcacatgtgaaatgcagtgggagagcagtgtcctgaaggaaaaggtggcctgctggacagccaagagaacaaacatccactgcaagtaatatgagctctaagtttggactaggcctatgtctgctctgagacttggggcaattcacttaatcagagccttaatcagctacggactagcaatatccatacccgctacttattttgtaaatctcctttctaaagttaactctatttattgttccataatcccataaattctagaatcttttcctgttatagccaagttgtctatcattgacagagatattcacctggttgttttggcttctctaatcctcctggtgagaacacctccaagggagctttcagtggcatttaaggtcacttgtgctcttggtcctagaaactgccttgatagtggttttagctcacatgaggaaaaacggagcccgagcagctaaggatcttgcccacggtcactgaattagcaatgcttgtgatgaacattcccaaagcttttatgagctctacgatctggaataggtctctttgtgatctgttctcctacttgctaaatatatgaaatattaaacttcataatcacaaagtttctgtatccatctaaaaatgccaaagattgcattgctatttattgagcgccaatgttcagagaatgttgctacctattgtggatgctataacatgcatgtaagaatttgtctcttgtctcaagagtgcttacagtttagttggagagacatttatatagacacttatgagacatgtaaaccactgacatagccacttgacatggctgaagttcaaatgtcaaaaggataagacatgaacagcaatgtatgccacaaggtcctgcagagggtgagatccatttggcttgaggtgttagtgatcagtcttcaaagagaaaataggagttttatctgtgcattaaggctgagttggatttgaatacagagacaggagaagggaagtcatcatgtgccttgaactagtgcaaaagtacagaggtaaagatagtcaccgttaagcgtcccacgatttagtactgaaaattgcagagattactgaatgaatttattaaaggaaataattctgagtctgtcaatacagtcatgcattgcttaatgatggagatacattctgagaaacaaatccataggtgatttcatcattgtgtgaacaccacagagtacacagacctagatggtatagcctactatacacctaggctatatagtatagctgtgaaaggaaaataaaatcttggaatactaaactcactatgccaaagggagaagttaagcttgggaaagaagtcatgcaaaaactgccttccttttgctcctaaacagctgcagca

SEQ ID NO: 5934 - DNA, 4738 bp, Homo sapiens
aatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaagcattgccagcagcattcagtacattcagaacaggataatttcacccgcagctgaactagggccatgcctgggacagacagagaatggccttccagcagacatgccaagaagcaagccagggtcagtgagtgaagaggagggcaggcccatttgaagcaacacagtttatgtaagtgtgatctaactgctttcactggaaatgggtcagactccagttgagagaaccaggggcctgaatgaccccagcaaaatcactgtggcaattctttcaatcacctctgagaatatggccctgtgacgacataatgacgtttggattaattccagtcggctgtgttttcccctcctttcttgcctccccgtagttgatttgccaaattttttttgtttgcttaaatacgcggaactaaacaggatacattatatgacagtctgtgataaatttaccactgggaatagggaaaaagtatgggataaagaaataggtatttttcgcctctcacagctgtgattcagttctgactcaaaaggaagtgtgccacctactgaatcacagaaaccacttcctgtggctgtttggtttattctggaggagcatcaggccaagtgctgccctgccctgaccctgactggctcttcagagccaaggcattcacagcttgaggtggtttggcctcagactcttgagaacattgcatattaaattacaagtgtttcgtttcctagcaaggagtctttagcaacatgaaaacgaacgtgtgttatttgcaaaccaagtatatcattactgaacctgaatatccttactttttcataaggtacgtattccggatgaccactcttaagatctgaatgtacactggttctgtttttcctgaggggaacttgggcagtctgcagggtggcatttaccagctgagggacttcaagagcaccctttaatcagtgtggcagcactcaacttgtattcactcactcagagtatttttgagcatgtacttattgccatgtgctgtgctaggtaggggtagagggtacagtggtgaacaagaccccacagctcctgacctcatggctcatgtgttctacaccataagggaatcaagctgtgtctcccggggcaggggccttcctctgttcaccatgcagccccagcatctagcacctggcgttgcataaaggaggctctaaatcaagcttgtccaacccaaggcccacgggccacatgtggcccaggatggctttgaatgcagccaaacacaaatttgtaaactttcttaaaacattataagatttgtgtgtatgtgttttagtccatcagctattgttagtgttcatgtattttatgtgtggcccaagacaattcttctatgtggcccaaggaaaccaaagattgaacactcctgctctaaatacttgtttgttgaatagatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggaacaaaacccatcagaagatgtcagaagataaggatttttgtcctgatgctacacttaccagctgtccctcagtgttctacttcttaaaaaaagagagatggataaacagaggcaacccgaggataaaggccttgctcagtgtcacacatttcagtcactaaataagacacaatggatgccagtattctcatcccctcacaaataaagagccttcaagctcttgcagtcaacaagaacttttggaatgatttcactgcctgaaaaggcagatacataggtgacacccacaaataggaagaaaatcaacctgaacctgagtgtgtgggctcactgactctaagcagtagagacagaagaaaaagttttagcaaagaagggttctgaaagaaaataaatatagctcgttatcaagtgctgtttttacacagtaaaacatgggcaaaattactcttctttaagtagtaattcttatctcttgattaagtcacctactcattcatttaataaatacatactgattgttttctatgtgttgagcactcatctctgtattggaaatataataatgaccaaagttgacaatagtaataacaataatagctaatatagcaggcactaataattatttgttgagtaatatgtcaaaattcagtgtgaacagcattctatttggggctgcatccactgactataacacagctaatctatctgaaatgttccagctttgggcctctctaacagaagaagctgttgttgggcctgcctctagttggcgatgcatccaccaatgagaatgaatttatgatcgaccactcttcctgtaaaggccgctggaactgacagcattgtgattttcttttactgttagttttaaattactagaaccaactcaattactagaacgaactttacttctttgtttcctacttatcaaaacagtaaaaacaacaagtaaaagaaatgccatcttaatattgttttgatgacaaaacagtattccttttagttgtgcttcaaatggaataagatgcaaacaggcttggtatggtggctcacccctgtaatcccagccctttgggaggccaaggtggaaggattgcttgaggccatgagtttgagaccagcctgcgcaacatagcaagaccgtgtctctacaaaaaataaaaaattagctgagtgtagtggtgtgtgcttgtggtcccagctacttttgaggctgaggagggagaatctcttgagcccagaaggtcgaagttgcagtgagccgtgatcgtgccattgctctccagcttggacaacaaagcaagaccctatgtcaaaaaataaataaataaaagacataaacatatctgagattaactttcagtggtaaatttgttccatatatgatttttaaggttaaatgctttggaagctttaaaaaccatttcagcccttttaaatgccaacttacactgatgatgctctcagatgttaggaaatcttttgagcagaaaatggaagtgggggtgttgaggcagggaggagagtgatgcaatattccttagtgtcatcctgtgatttcacaatttgtttttcaatctgtttggactttcaaaagggaagactctcatatgtcaacaagcccatgaactgaagcttaaaacactggaaacaacaactgtagagtttcaagtatatgtacatttatgtattcatgttccttgatgggaatgctggctggtgtgaatgttcaatctcctgagaaatgtaaatttttctctgacagatttattagcttgctgtatctgagcacatgagcaaaaacaatgcctaataagaaaactttctctctccttcaaagtcaaacttgggagaaatgaagggaaatcgagttttctttgcttgacagtgttcaacattcttgtagtcagtgtgctcatgaagattgcaaacttttttttttttttagagcagctaggactacaggcgcgcaccaccacacccagctaatttgtgtatttttagtagagatggggttttaactatgttggccaagcttgtctcaaactcctgacctcaagtgatccattcgacagctctttcttttttttttttttttttgagacaaagtctcgctctgtcacccaggctggagtgcagtggtatgatctcagctcactgcaacctccgcctcctgggttcaagcaattctcatgccttagcctcccgaat

SEQ ID NO: 5935 - DNA, 480 bp, Homo sapiens
ttccttgcaaaaaccctcagctcacccgagggccaatggaaatttattaattttttttgtccttttccatctttccccaagtggcttttccttgcaaaatgcctgacatgacaccagaggggaacctgggagcggggggcaccccaagggggcagcccagggacttaaatacaagctggagggcagggcacaggtgggacaggcaagagacagcacgagggacatggcttctcagggagaccaaagacttgctttcttgcaggaagcagctgtgccagagggcaggggactaggatcctgggtgcagagtgggtgagcagagagggttaaggctggtgcccagcctctggcacggtgggccttccgcctccgcctgacatggggacaaaggggcacggtgggcaggcagcgcatgggtctgtctctggcagggcagagggcggcaggagcagactccctccaggctcaagacacaggccc

SEQ ID NO: 5936 - DNA, 783 bp, Homo sapiens
gtcatttccatgtgcactgggacgggaagtcaaacgaggaatttaaaaaagcaaaagttgaccgaagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctgga

SEQ ID NO: 5937 - DNA, 5242 bp, Homo sapiens
cctatgggcacaaaaagcaggaacgagtagcggtggctgaagaacgagcaggagcttgaatttcagttttcttatgaggaattttccagaaaagatatcttcactgtgaaataactaaataaatgcccactcagtacagtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatggggtgagtcagggacaggtctctttccagggaatccaggatggtagggaggttggttgtctaccttgatctcactttttccattgtagaaactgtgagttggggaaagttttccacacacttggtgctggacagattgtggcaaggggcaccacagatataaaaatctgattcttttaccatgctcagagttttttcacttctgtgtccccaggaattgactcatcctcatatctgagttctgggatattgttggtgataatctcagtgctgtatatttgtttttggttttctggtgtggaagtgaagccagcttgcgtctacactgccatttttgaactagaagtccacctgatgccatgtgggtctgctctaacaaagatgcctgtagctgtctctgtaggtacaattggagctactacctcataaagtttgtggtagcccactatctggtttttggaggggctagactggtaaattaaatggagatacaatttgaaccatcatccccgaatcttttaggtcttttaggatggcattaatttctgccattccctgaaatattattttttgatttactgtattggtatggagaagaggtcaatttttaaagcttccacctggccacttggcctttatcactatgttagctcttaccacacacaccgagaaacctggtgccactaatcaagtgtatttatcacaattatacactcaaggactaggtgggtctgtggatatattgtgagccagacttgggccaggacaccctaggacttggcctccataacccttactctaatcaagggcatatagtgagagttctgtgatatcattgttaactcagaccctgtttccaacagatatcaaaatgttgagtattcccctttcaccactgtatgatttcctgagtaatggtgataggtccctttggagaaggactagaggaatcattattgtgcacacttgtggtattacacaatccttcctcctggggacccagattcttctttagttaatgggcctggatccaaaaacggactcaggtctggaaatcggacaaggggtcatgattattttttatttttatttatttatttatttatttatttttgagacagagtctccctctttagcccaggctggagtgcagtggcacaatctctactcatggcaacctccatctcctgggttcaagcaattcttttgcctcagcctcccgagtaactggattacaggcgcgcaccaccttgcccggctaatgtttgtatttttagtagagacagggtttcaccatgttggccaggctggtcttgaactactggcctcagggaatccaccctcctcggccttccaaagtactaaatttatagtcatgagccactgcaccccgccagtttaacttttttttaattggcttagttgccaagagaggaagttggggaggatcctgaggagtgtatgttttgtccttggagagagagctcattgtcttcaagcaaaagagggagcacactagcccttattagagaagagaggggcacttctgtagccttagaaggttctggaaacctgaggattgaagatttttcaggtgcatcaacccagatggtttcatcccatgtgtcagggttccattttttcccaatcagggtcctgacaacagcacagtagacctgcctagcttgggtcctaacttctttggagttttattctcatgactaagtcctgggcctggtcctcagcttcctctcctcattggcttgagaacctgagagtctcatattctacgagggaggctttctggccctcacactgagtttttgtttgtttttgagacaagatcttgctttgtcactaaggctgagtgtgtagttgcacccaggctgggagtgcagtggcacagtaagctactgtaaccttgaactcctggacccaaattatcctctggcctcagcctcttgagtaacagaacaacaaatgcatgccactatgccctgctgattttaaatttttgtggagatgggccttgctatgttgcccaggctggtcttgaattcctggcctcaagctatcctcccttttcagtcttctgaggcactggaattacaggcatgagccacggctcttggtcccacactcagcttctaattaccaactaatcactctcattcttttattttgagacagggtctcattctgtagctcaagctggagtacagtagtgcaaatatagctcactgcagcctcaaactcctggggtcaggtgatcttcttgcctcagcttcccaaatagctaggactacagccacaagctactgggcatggataattttttaaatatttgtagagacagggtctcgctatgttgcccaggctggtctcaaactcctggctcagcctcccaaagtgctgggattacaagtgtgagccactatgcctggcccattctcattcttctgttatctttttccaaggtatcggtctagctcagtaataactcttcagttccactgtctacactgtttcccacctgatcttcgtgcctgccggtgcatttctttgtgttgacatgccatctcagttcaccactagtcaaagttttaataactgcactgtcagggtgtgctagcagttaacttctccctgccccagtgaggagactctcatcctataagtgagaaggcaagagaaatggctccaaaagcacactggagcacctactttcctgcaacccttctgataccaagtatcacagatgctgagatgaagattagtgggtaggagatttggattgccacctgtggaaagaaaggaaactccactgggtggaggaagaatatggactatgatgcaatctcaaaggtggccttagctgacactaaggggaactctgaagctaggatggtctttcagattgttctaatatggggcaatgggactagtctttgcatgcagcctggcccaagaaggaagtgtgacttcagatgaggtggctcttttcacttaagagggcaattctactgacagctgagggccgttgggtgcacactgccagagcgagaaaacaaaatcctctgtagggaaggggactgtgtggcatatcacagcacaccccgagaacaagggagcggctcttcatcaaataacacaatatgggcccacatattcccagaggctgctatagtgctgggcacattagtgctcaataacttattgaattagtattatcatattgtgctattgccatcctcatcttttaaagtcacttatcacttaatggatgttcttgttagaactgacactatgaagatgactatgacacaattacctgttgagcctatttgagaaattaacctatatttaacaagtttgactaattagattggttaagagccttagcagagggctaaacaaaatggtgttaaagaatacacctgatggtccaagaaaatccctaactccctagaaggtctggatagtctgagaagtgacattcgaacagtgtaatgcactttcctccagagccagaagcagggaaagcagaggcagcagcaattttatcttctgggcaccttatcctcagacctcattttatcaatacatacggactgtctacaaccacgtaatatccttttcatcagccttatgaaattttcccccaatttatccaagtcaggatttcagtatgcagaagtctaatgtcatcttggagagttcattgtgcctcccccatatccaagaccatttactaaaaccttagttcagtctttaaagagtcacaagatcctattatgcctagttttttttccagtcttttaagtctattccttaccttgccaaaaaagtacctgtttctatggtttaacaaatggagcttagaatatggaactatgacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggagtggagttgctgggtcatatggcaattcatttgaggaactgagaagcttattccatggaggctgaactgttttatattcccaccagcaacgtgtaaggttccagtttatctacatcatcaccaacacttgctattttccatttcattaatgatagccatcctagtggatttgaagtggtaccttattatcgtggttttgattgcattctctattgactaatgatatcgagcatcttttcatgtattttttggtcatttggtcatttttcttttttaattttaaaattttgagacaggctctcactatgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatctaaaaatttatcttgggtttccttttttcccccagattctgtatcctccatagtcctattcatgacatgggtcgttcatctctgtattctaaaccctcaatgaa

SEQ ID NO: 5938 - DNA, 738 bp, Homo sapiens
atgtgtctgtttctccttggagttctatgagtcctcatgtattttgaggctctgttattaagttcataaacctttaggaaggattgtttttggatgggctaagatattattcgctattttaaatgttggaccatctcttgttccaaacatgcccatgggtgagcagaattgaacagcacgaactgtatgcaagactatttatcactgcgtaactaggacatgcctctccactactcacaaatcatgttgcccaactttttcaaaacccttttggctctcactttaattatcatgtttaatctcttgaggtactgatacctgaaaacagatgtcattaatttcccttataatcttgacctccctattgttactgaaagtactaccattcttagggaggtgtaggtgatgcattcctctctctacattctatgacactgcaactacgtatttaatacaaagcagcctttgggggcggggcggggcggttaacaaaatgcatctcagcaccagcctagagaaacttttctgtgtgtaaacagaagaggggttaccatggagaaattcattacggatttcgggagggctttttcctcagaaatagagtgaaaagaataagtcgttgtgtaataaatctgatactgacgctgtgtgacttagaagttggtccaaaagttcatcttaggcacttatgcctagatgatcaactacacatcttctgcaacaggtgacacgaacctg

SEQ ID NO: 5939 - DNA, 788 bp, Homo sapiens
gttactgctctgtattgaaaaccagttctgttttacttcaaagcctttgctatacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacatttt

SEQ ID NO: 5940 - DNA, 3925 bp, Homo sapiens
ctctctccgtctccgcctccgcccccggctcctccccggccccgccccggcactgacattctatctctctcccgtctccgcctctgccccccccccggccccgcccctgccctgcgccggcgctggctccgtctgcgcctcagcctcggtcccgcctccagccctggccccgccccgccgctctccccttctccgcccctgccctggctccgcccccgcctgcccgcgcaccgcagaaggcctcctggaacttcctggacagcttctcgatgacgctgtagctctccacgtaatcgacgtgttcgtcctgcggctcgctggcgatctgccgcagcgtggccttgtccacgctgcccactccgatggcgaacagctcgacgccgctggcccgggcccgcgcagacacgtcctgcacgctgtcctggggcctcccgtctgtcaccacgatgaccacctgcgacacgcggggcggtgtgacaccgggctcccggaagcccacgggactgtccaggagaggaggctgaggcccggagaggcgggaggactgccgggtcgcacagccaggcggcacccgggggaagaggacccggctggccgaagaggagacccgtttcctctgactgagagacgtggctggggggctttccatctgcttcgcctccctcgggcaggcagctctgagatgcccggagggatgtgatgccccatcgccaaattggggtctctaaggtcagggccatgccttcccctcagactgaggcggctgagggcagggtcctcaggctgatggctgtgggagtcgtgccacgcccctcgtgcccccgggaggcccggccggggctgggtggggggatccggtggttccacatggtgcagttctgcgctttggccaccagatggcagccgaagctaagggatggggctgccgtctcccgtcttgctgtccttgtcccggtaagaccggggaccctggaccagggaaccgacggagggccactcccatgtggatgcccaagggaccaacccaagaaagatgccgcccttatcctcctccactccccggtatgatacatgcccctgccagagagggaaagaatctgcctgctcccctcccactaggctcctctggtctgtaccctggaaagaaagaggtggcggactctgtcactgagatccggcttcgtgaccccctgtctgcacccgccctgaggctagggcgctcccagctctgcccagtctgggttaggcatccagtcccgctttgctgcttctctgcttctgacttgggtctgtttctgattcctgggtcccatccttagccccaggtcctgacaccctgtcctgatgacaggcagttgagacaggccgtgtttagaaatgcagctccacaagctacaggtcaccttcctgagcctcagtgtcttcaactgtaaaaagggttgtggtgaggttgagtgagatgactcctggttagaagccagaaggggcaactattatttttaccatcattaccctgggctacctggggagtgactttgtacaatctcttcctctccaggggcctgggctcctggctctgaaaatctagctgtgactattcgctgccatcccgaggcccactgcctcctcgagtccctactcccctccctgcaacccagctttcagattgtccaccttgctgggtcctcccacaggtgaactccaggctgaacacctggagtctggtgccagctcccccagcgccgctgtgtcacctgctggaggagctctctcctcacttgcccaccccacgccaccacccccatctccttcaccctctccaccacctcaaccatcagcttcatctacagcaccccgtgctgaaacttgtagttggccccaagaccgacaggctgcctgatacgtcatttctctaaggggtggtaatggctgggattatatgctgttgtctctgtgaatgcttttcccacttattggctgagcaagttgcttaagcttcttatgcctcagtttcaccatctgtaaaatggggataccacctccgagcagaatcatgttcatttatccactgtgtgctagagagtggggtatggaggagggataagaaagaacctcccctgagctggggccctgagcagggaagtggcgactcgggctaacgaaggctgcagtggggaagtgctggagcctgtgggggtgccacaggaacagaggacacctggcttagcctcaggttctgtgctgagccctgaacatgacagtgaggatacaagtcctgggaaacgctcagccctctgcctggagccctcactgacagcacaggtggcagcacagcccttccatttctgagcccctgccctcggagaattatgaaattaaaaattatcaaatgccatgatgggaagccttatgcttttgaactcagtcctcagcagcacttggagaaggtgttatcattactcccattttacaggtgaggaaaccgagcaccagtgacatgacgtcacttgctcggggtggcacagctagtatggtggagcagggcgtgaacccaggcaggctggtggcggaggccacaccttcactcctcccataagcatctggcctgtctgcaatgtcttcaaggggctcagactggtcgggaaccaaggtcaactaaactgaaatgattctatgaaatggccacctcacggggcatcatgggaatcaaagtgtctgcaggcaaagctcataactccgagcgggagcctccaaacagcagcatcctagcagggtggcgtgcacgtaccttgctgatgtcaggggacctggaacgaccaccctctgcatcgccgaaggctttggtgatagcgaactggatggccaggccggtcatggtgcctgtggacagcggctggatacggcgcacagcctgcagcagtgcggccttggagacatgagcccgcagcgagaactcctgcttcacggtgctggcatagttgaccatgcccacccgggtggcattgggccccacgtccagcgactcgatgacctgggacaggaataccttcactttctcaaattcaacaggccgaacgctgcgagagctgtcgacaacaaacaccagggtcacacaagggccatccacggtgaccagcggtgagaaacgcaatgctgtcctcgtgccatgctggaggtgaacgaggagaacgtgagctggggtctcctcaccaactgctccccccaccccaacccccctgacggccagggctgtgtccagggctcagggcacaaggctccgttagctgggcagcagctggcccatgaaacagccctttcagctccacctctgaatggcagttctatgggctcctcggaagaacacaggcgccttctctgtgtcacttctccgctcattagcagagctgcagaaatacactacaggactcaaaattgagaacagtgtgtccggtatgagccagaaggaaaaaaaaatgcacgaaggggccttctgcaaggttgctcacaagtcaaacaggcagctgtgaagggctctgctgttccctcctcctgttttcacatccctcgggcttccagaaacttaaagccgttagtgtttcatgcaagagagagcatctgtgatccacggagaggcccctgggcagtgtggttcagtgggaagcacacaggactccctccccagtgctcccaggatcagctctttccctaaagagcaaacctggttatctcgcaatgacctagctaacacaaatgcaacatcagccggggcagcctgcccccttcactctttgcccaccatcagctgtttggcagtatccatatacgcctttaccagtatttatttaatctttttgtttaattcactctaaaccaactcacttcttaaaaatttctctgccttataagaaataatagccatgaaatc

SEQ ID NO: 5941 - DNA, 2041 bp, Homo sapiens
tcttcgtccatggtatttaccttcatgtagaacttttaaaaaatgcaatatagcttggtatttatcacttaagaaatacagaggtaagtctgtccaaaaacatatgtattacgattttccgaatttatttgtaccctagaatttctcttagtcctcttttttaaacatttaaacatttataatttttcttagtgcggtgccttctggaaaccatccaccatttgcacactaccccagtgcagaagatttagcaagtaaccagttcctggaaacgcgaatggcatttgtggaacaagataagacacaacttaacctcattttctttcatactaatgtctttcatttgatagatgccattcatcatattccttttaacattgctccatcactgaactgccagctatgtgaataagagaatgctttctctttctttgagctgaaaaggttgcatcttctaggcttggagaaacaatgggaatgggcttttccataagaccatctttacttacctttcagtgctggattatactgcaaatcttactacctaagcattaatttttcttggttattgctccaacatgcaacagtgtcagagaagcaaggcaagcactatttaatacctgtttactgagcatcaactaagcacaacacacactttgttttgggagcttcataaatgcatcccacctggatccttcatccaggctctcagagcttcctttccttccttgttcgattcagaattcagttacattaatgcagaagtttccaggacttcagggatcctagggagaggtatccaatgatgtttcagagacagagtaggccctagaaaattttattgtgggagaatgtgtttgatagattctgttgactttaactttatggatttgtactttcactacatcagagaaccatcagaagtacaggcaatggtctgtaagaacaatttcaaatatttcttctagcagatggctgaaggagaagaggaaatgtaagctatttaccctggaacacttgaccagatttcagaatatggggcagcaagcatttcagacaggcattccttacattagaaaaatgtgaagaggagttgccatgtttatcagaattttgcaatgggacaaatttaaagccagttgtctttcatcctgagtggttctctcactcttcaaaatacttgggtgattacagagaagggctatgtctgtctgtctctctctctctttctttctctctctgtctctctcccacctccccccccatacgtgtgtgagagagaaaataaattatatatttccgtaagttaaatttaatgatcagatatctcacctatattcttacacttttctatttttcacagaatatacaagcacaggcatttaaatgttagtcacccaaaactccagatgctaagcagtgaaagtttatattctgccagcatatcagactctgtaatgagtctgatttggtttaattcctttctactgtttagtcatttgatgagctgcagatggaaatttaagccaaagccataacatttcagctaatactttttatgctgctgtaagaatttgttgtcatgtcaatttaagagagttgaaatcttttttgagaaggcattcaaatctgcattaagtgcttttatcaactctaatttgatatacaactctgactgcttctgctgttcttaatcaattgcaaagtgcaaagtaatttagcagtggaagacagctttgcaattccaggatttctcagctaatgccataagcacaacattatggaaatatacaattaaatttacattaaaaatttttcctatgcttaagaaacacgaggccaacttctttgagtttagccttaaataggtaaatatgtattttggcagccatgaaaagaatagggtattagattaactagggcaatactttggtaaaattccattggaatgttatgtttatgcaggagagatttggccaatcaataagatggtttattttgtaagtcaaatcaataaaatgtttgaactgtataaatacaa

SEQ ID NO: 5942 - DNA, 577 bp, Homo sapiens
ggtggcctcggttcccctcaccgcccggtccagcataacccgctaagttggggggaggccgttcctcttgggcctccaggcgacaaaccccctgcctggccggcacgaaagcagtctctttggggcctctcggagagctccgggcagcttggcgcgctctgcagacggcggacagcaagaaaatggcggcggcctcagctgaggcgggcaactaaggagggactgactcttcaaaagacggtccccgatctcagacaccgtcgtcaatatagcccgctgttggtctgcagggattccctcttcttgtcgggccgggacgaaggccatttccaagcggatggaggtggattgtaatggcggccccggacgactcgaaggctctgtatcggtaggcagaatcctccagctcgttctagaggctgctccactccagcacgaaatggcgccgccgagccccgcgccagccctttatatataggcggggaggaggagcttcgccgctcatgcgcgccaccctgcttgagcttttccccaccccctccgcgcgcgcgcgctcgctcacgcgggtgaagaagct

SEQ ID NO: 5943 - DNA, 2527 bp, Homo sapiens
gcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatcccagcccccttgaagcttattaatcttgggggtagaggagtgagtgatggaatgaatggacaaaaaagctggtaggtactatatttggtatgtcagagagtgacaagttctgtggagaaaataaagcagggaaagtgagaatgatgtgataaaggtgtttgtaaggcagaagagagatatttttaaatagtatggtcaggaactaccctacagagaggacatttgaacaaagacctagaaacaataagggagcaaaccatgtaggtacctgggagaagacccttctgagcagatgaaatagcaaatacaaagaccctgaggctgaagcattttttgtgtgtacatggaacagcaaagaggcacatgtagctgtgatcaaatataaacaggaagaatagtagcttataggatcagagagttgataggggccatatcttgtagctgtttaagctacaagatatctgagctacagattcagtttttcatactttgttttgagtgagtgtcgctctgttgcccgtgctagagtgcaatggcatgattctcggctcactgcaacctccgcctcctgggtccaagcaattctcctgcttcaccctcccgagtagctgggattgcaggcacccaccaccatgtccagctaatttttttgtatttttagtagagatggggtttcgccatattggccaggctggtctctagaactcctgacctcgtgattcgcccacctcggcctcccaaagtgctggaattacatgtgtgagccaccaagcccg

SEQ ID NO: 5944 - DNA, 578 bp, Homo sapiens
attactggaaaaggcaagagtagagctatcagaatgtcttccttgaacatgctgtcaacaaaccccaggatttttataaaccctatgtgaaaaacacgctaagaatctcttttcttcttagcatatttttcacttagggtttacaaaaatatgttttgaagaaagcttgaaaagatcagtggaaaaaaattcagcaccaaattttctctgaaaatcaacttgtcaaaaaagacgtgattaacatccatcctgtaaccagcacatgaatgatcttccctctttacgagtgtgcttcagcaaaactttaatctcgacccctccctctttccacttttaatagtggatggatgaaaaggcaagaggaaaaacaaagcagccgaaacacacccagacgcacacttctgccaagcatagccaccacgtgttaaagaaaatgagatataagtcagttactcccggaggcaatgctgctgttcagctcttctgtttttgtggccagggtcttcatgaacactaataggggtaccaggccctcttcctcgttagaagaaatcaggataacaaaggcatattgggca

SEQ ID NO: 5945 - DNA, 21452 bp, Homo sapiens
acttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacgtatgtatttgctgggatcaggggcgctgtctctgtgtatgtgggtgctctgtctttctcaccttctttctcgatttttgctatttatttctctgagggagggttttttcccactttaatttcttttccctagtgtcagctgctcaagcctgaccagggtagaggtgagaggagtgaaccatcccctgcttcccacctgacctcccagcttttaccctatttccttctagtggacagacagactggttctccaagttgtttgggtgtcagcgtccatctgtctgtccgtgcaggtcttatgtggaaggtaagggagtgagaagtgccgaaaggaagacagagggacagttttttcccaggggttgccttattgaaaggtctggccctgggattctgaggctggtggggagccgagtggccagggtggggtgtgggctgggagaagtggggtaaagctggtaggtttgtcactgcgtagttgggaaaagtggggaatggtgacgcagtcactgttgcatctggttaggagctctatggggacaggtagtgaggctcctggggtctctgtggccagctgagaggggttaaggatgagctaagaagggaagctagcatttagagattaaatgtcatccttttggcgttggaaagttgtttaccttgcgctctctgtgtctccatgttggctcccttccagttcacatgtgatggccttccctgtactgctgcatcattaactaagtgactgagctggccttccattggccaggggagggctctccctccagacacttcctctgattggtgggtgggccaatggcaggtgaaaagctttttttgattggctcagggcagggtatcaaatctgaatttgcatttcacttgcttaaaggggagcggggagaagcccagcagctttctaaaatctctttaggggtgtgcgtaggctcctgtgtctatgcctgcttttgactgcccagttgaagcctcttcctatgccttttaaaatttcacgcactataaggaggaagagctcagggctcccaaaactttttatttagagggaagaatgctagggagatgggtatgcagagggttgaccaaattggaagaaaatatttattctgtagtttggtgttggaaaagggaattttccaatcagccacacctcagtgttgcggcaaaataattcttggctcccctggaaacgcatgggcaaggtagggcagagctgctgctgctgatactgccaccaccctgggcttcctgctgactctgggctactccctggggacaacagatttgcattgacgtccggggctgtccagaggccctcaagagccagttgtgagctgagcccagtatgggaaagatctaccttctggaagctactactacgtggtgcttggaaagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatcatgtctgtgtttttcatctattatttcccattcataattctgtgatgataagaagtgggtcctgaaaaattaattggctgtgcagatcttgcctacttcataaagaatttgaagtaggttacagccagccagacattaaaaatgaagcccattaagagaagaatgaaattctatgagccaagaaataaaatgagagaaaagattagggaagagaagaaatgttgaagatcaaggctgagggatgctccctactgaatgggaaaactccttagttccacatgggctgtagacacagcccttctgccagcaactgttcctgcaaggaactggtgctcaactaaacatactgtcacatggttccttgaaggggcacagcactgatttcacttgcattataaaagattgagtggtgcttttgactattagtttatgtcaacacttcaaaacaagatgagccagtttttttttgttttttttttttgtttgtttgtttgttttagacggagtctcaccctgtcacccaggctggagtgcaatggcactgtccccgctcactgcaacctccgcctcccgggttcaagcaattctgcctcagccttccgagtagctgggattacaggcgtggcacctccacgcccagctaatttctgtattttgtagtagagacggggtttcatcatgttggccaggcttgtctcgaactgctgaccccgtgatccacccacctcagcctcccaaagtgctgggattacaggcgtgaaccacctcgcctggcccagtgagccagttttgtaaagctattcagagattagccagatttgatttgataggggatcaagcttgtaggatcttcaggaaggcgggctgtggccccttgatcaggctttttgcacaggaggtgcatgactatgaactaccctcagtagaactcttttaagccagtggcttgcaataaatgatggcaaatcagccacctaggaagccatttctaagcccaaccccctgccacagtcttcctctagatggctgccctgcccagtgggctgagagtggggggcggaagtagcatttgctgggaagacttgccagtacatatgttgcaccccctcactgcagctgcagtgctatttcaggctgttgatggaagaacccatgttctaatccccaggatgtggtgggaagaccctaagtggtggtgttagttaagaccctaagttatattgttttgttcacttcccactgagataggctacaatagtattaaatacctataggtcagacatttttggggtctgttgtactacctaccaattaaacagtttttgatccgcccaccacgctcaaagctccagcctaggtgttgcaaatacagacgacagatttttgctctcaggaggccctgattccagtcctcaaacgattacagattccagaagcctgcaatcagctcactggactgcaagggccacccgccctctcagaagcgccgggagagaacaggttttcttgccttcttcagctgctagagctgcgttctttggcttgcacccccttcctctgtcttccaagccagcggggcagtcttttgcttcagtggccatgttgtcttctggcacagtcacatctccccctgcctccctcttagaaggacccttgtggttacatttagggcccccacctggataatccaggataatctccctatttcaattttcttaatctcatctgtaaagacccttttgccatataaagtaacattcacaggttccaggtattaggacttggatatctttagaggccatcatacagcccaccacaaacagctccttaggcactcattagaaatgcagaacctcaggccccaaccgataccttttgaatcttctgattctaatttaagaagatcaccatgtaactcactagcacactaagacttgagaagcacgatgctatgggaacctaaccaaagaattctcaagtcccaacttaaatacaaatttacagagtatttttcctaggaacgctttcaggtggaggagattaatcagacgatagataattttcctgaacaccattctgaagtgcttctctaagcatttgttcctgaattctctctcaatgaagccacaagccccaaacaccaggattactgtttacaggggttcctgtttacagtagtttagcacagggtttgccacactgcagcatattattatagtttagttttgtaaaaagctacatgagagaggtaaatcttataaatggaggtggagtctcctaacaccagttttaccacctctgtacaggtttccctgggctatgtactatcgaatcaggaatcaggaagggcggctttttcaaatgttatctatacttttggcaatttgttcaaacgttctgctggtatgtgagagggaaggaaaaattgtttattgaccacagatccacaatattatacttctcctatacttaagcaataagggacagcatttaaaactcttttaaaaatgttaatcttggctgggcacagtggctcatgcctggatccccagtaatttggaacactgaggcaggcagattgcttgaggccaggagttcgagactagcttgggcaacatgcgagagcccgtctctacaaaaaaaaaaaaaaaatacaaaaattatccaggcatggtggtgcacacctgtagtcccagctgttggggaaagctaagttgggaggatcccttgaacccaggaggttgaggctgcagtaagctgtgattgagccactgagctccagcctgggtgacagagcgagatcctgtgtcaaaaaataattttgatttcacggaaggagaagaggactagtcttataccatatcccaaatgaaattgaaaatgtcttctgggaatcacagcaatgactcaaacttctgaatagtgactaggtttgagctggtaaggaagggattgtcaaatgccgtgacagtccacaggagggcagcagtgctccgatttacaaaggattagtcatactagtgtaaccttttctgagtgagcctagaaattctgatgaaaacagtgtagtccaggaaaaaaaaaaaaaaaatctgtatgtacaatcactcaattttgaatcatttctggaagttattagactccatgttaaatcctacttaagtacaagtatgcaaaatttaaaaatatgcagaaaagctcattcttggttaaaatgttagctgaaagacattactaagttttagaataccatagagttgactatttcccacaaaccctaaaatctacttgaacaccacaaattcatattccttctaatcccaagtcccttcagcattcttacagatttattgttagttaccttacaaagtaactaactgtccccatgtattttatcccaatttaaaaaatacattacagtctcaaggtcacataagattttccaaaatgctctattcatagtcaatataattttcaggccgggtgcggtggctcatgcctgtaatcccagcactttgggaggccaaggtgggcggatcacctgaggttgggagttcgagaccagcctgaccaacatggagaaaccccgtctctactaaaaatacaaaattagccagacgcggtggtgcatgcctgtaatcccagctactcaggaggctgagtcaggagaatcgcttgaacccagaaggtggaagctgtggtgagccgagatagtgccattgcactccagcctgggcaacaagatcgaaactccatctcaaaatatgtgtgtgtgtgtgtgtgtgtgtgtgtgtgtgtgtgtatatatatatatatatatatacacacacacacatatatatataattttcacctagtgttttattaaacagaatgcttctgtatttttatgtttatttgagacaatgcttctgtatttctaaacaacagctagccttgttcagttagccaaacaacaaaaccttaattcaagtcttcaatgaaattttctgatttaataggctgaattaagaaagccataattttcttctataaatataagcctttaacttctatctttacaagtttatatagaaaaatttactgtggggcttgagatttactaatgcatgggttttcaaccttagctgcactttggaatcatttaggacgcttggaaatccctacacccaaaccacatcccagatcaattacactagaaatctctaggggtgggacccaggtgtctgtaaatatcccccggtgattgcaatgtgcagccatggttgagaaacactgaagcctgctctgagaaatttagcaatccgacttaattcaaatctgcagagagagcaacaatgatttttgcagaaacaaccaaatcctactagttacataaattttatactttgttaggacttgggtttttatttagctctacatatgcgatcataggatgcagaagatatatcttctactggacacgtatatatagatgcttaaatgtggctatcccaaggttaggtaataataaagactataagagctgggcagaaatcaggcacagtttcatgaagggtaatatctgagctgggccttggaagatgcataggatctcaacaggacagtaggtgtttcaagcaacaatgaactaggaatacagcagaaagcacaggggaaatggtcaggcttgactgagagtaggttatttgaagaagtgcaatagaaaatgcttggggaagaaagttgggatttaattgtaaaaggtcttcaagtatcaggctaagaaatgtggacttcatccagtaggtaatgtgatgtcactggatatctgtgcagtatctatgtgatgggttgggagtggagaagcctggggatacttaagggtctgagctaggagggacaggaggaatggctgtgggagtggaatggttagaagatgggcccaattagaaacatacttcaatttgagacaaaacccactagaaataaacacatcatcatgaaacatctccaaatgtacaat

SEQ ID NO: 5946 - DNA, 814 bp, Homo sapiens
caggcagctccagtgactgacttgcccacagtcacatggctagagtctgaatacccccgggaaggggaaggacctggcagcagggagtaaccacgactggtcagttgaagaaggtgaggatgctggccccgaggtgtacaggaagggggaaaatgtgcgagggcctttacggtgggcagtgccagctatggccccccagcagacaacaaggcacagtggggcttggggactgggggaggccagccctgtccgcctgtccttgacatcaggaggcttgtgagtggagtcctgcaacccccacccaacccctgtacaacgggggttccatttctgagacccccaaagtatggggcatcttagaggcccgccccacagctgagcatcatctcaaggaccttcccccatgacgggatcctcagaaagagccagggccagccgagcagaaccgaggggcagggcggggggcctggtgtggcctcctgcccgccatgcccctcacctggcaggggtggctgcccgacccagaagctccaggggcaccaggaacgggttcaggggacagatcccagctgcttgccaaggcgatttcagttcgctgtgctcggccttctcggtggctgggggggtctcctctggtgccttggagccagccccatccccttctgctgcaggccccaggctccctccagcgggaatgggctggggggctgtcaggcgtaggtacgtctccgtcatatgctcaaccagggctgtgcagggcaggagtggcagctcctctggaagtgacatgagcaggtcgaggaccacagcggac

SEQ ID NO: 5947 - DNA, 11753 bp, Homo sapiens
gggccgggctgtgctgaggccggcggggtggtagcacaggaggggttcgcaggctctgcggccgtgcgtggcggggcgtgggggcccgcagggcggaagtagctcggagagacgggctggggcagggcgtgcgttcgtgcggtcaaaatccactggtggcgtttggggtgttcccgtggacgcggcctcccggcaggcggacctccaccgggtgggcgcggcaggcgggctgtgcgggcaggaagagcgacgagcttgagagtgggagatggggtgcaacggcgggcctctccggggaggtgacactgccgctgagacccgaatggaagggcgcgcccggcgggggaacagcaggcgccgaggttcgctggaagcagggaagggaggcccgggtaccggctcgcaggcccgcgcgagcttcgcggcagcggcacggagcgtgtgaacggcgcagcgccgaggcttcatccatcggccggtgcagggtccgggcagggagcactgtcgaccagggtccgaccctgggagagtccagaggtggcgcctctggcagggacagaggagggggtgacgctgtaggggtgcaggcaggaggctccgcgtcaactccccacactgacggggcggatttttttttttttttgacagagtctcgcactgttgcccaggctggagtgcagcggcgcgatctcggctcactgcaacctccgcctcccgggttcaagcgattctcctgcctcagcctcccgagtagctgggattacaggcgcacactaccacacccggctaattttttttgtatttttctggtagagacagggtttcactatgttggccagactggtcgagaactcctgacctcgtgatccgctcctaggttcgccttggcctcccaaagtgctcgctcctgggcgtcccaaagtgctgggattacaggcgtgagccaccgcccccggccgagggcgggttttgttctctgctgtgcctgtcaggcagtcgttgccctgtggttatttgtggagggattgacggtgcgctgagcttcagactttgtctgaacagcttcgtggcagcaaggaagggagaagggaacagatccaagccgatctttgggaggagagaaccagcatgacttggagactttagatgtcagagcaaaggacagggtgcagcttggtgacccggagtgggtgggtgggtgaatggatggatagatagtggggatgtggtctgccatcactgccctcttccctgtgtgggaagccagctcttggtgacttcctgccgagacccactccctctggccctgtccgagggtgtcaagtgtgcccttgacccttcaccctgggctaagggatgtccaaggagttggggacaaaggcagctaggaggaggagctacctcccgagtctgctgcagtaagtcaccagtgtgttcctgtgggtggaggctggcaggcccatcagtctggtttgggtacccgttggatttgggtttgatgacatgtaaagtgagttagagtctctgcattactgtcacacctgctgtgcccaggcatggaagattaagtggaacagaggggccgcccccctgctgaaggggccccagagtcggcgctaggggagggggcagcctcggtggtccaggcaggcataggcggaattctctgaggtggcattggagtccagtggtcagaggtgctaaaaggccccaaacctagagcccatgcccagggccccactgacacctggtgggcaggggcagcctggtgaccccacatgacatgggtgggcgtgacgcagcaccagctgggccgacagccctccccctgctggtttttaatgctctgcagtaatgtcatttggcctgcgaataagctttcacacattttatattaaatctacaagtatgatttattcaggcacttacgaatttaatcaaatttgtttctaaatattactgatttttgttatcaaatgtgccatcagctgttgagctttgagaattgagcatcctggcttttgccattttgaggatcagcagaagcatgtctggaagaaatgtgagaaaataaaactcaggagcctacccccaccctgcccttccaggagctcagccccagagccaggctgctaaggccatggaggctgagggcagtggagctggggtttctggagcctcaggggccctggtttgctggaagggcaggcagggcttcatggagggcattaggcagtggccagagccctgcagtgctgggcatgggcttctcgtgggctctggccacggccctgagctcctccccttaccttcccagagcggagggtcacctgctgagctgggcacgggcttctcgtgggctctggccacggccctgagctcctccccttgccttcccagagcggagggtcacctgctgacagtttggggcggctctgtctttgagagcatgccctcatgaaggcagaatgtcctccctgcctccatcctctgtggcccggtggctcctgcagtgcctgccctcagaggctggtggcctgggacacagggatgaggatgggcttggtggtgctgcaggtcacagtgggtcatgaaggagctttgggggtgttgcattctctggtaaagcacagcaagggagcccttttacccactactaaaacctggctctgcactgaggccatgcgcagcccagtcaggtggacgagggggtaacgactggaccgtggggaggcatcagaggaggagctgctgagaggcgggtcaccacagcctggtgcctgtctggagagggtggggctgggggaggtgctggccaggtccatgggggtggccaggctgggtctgaaagggccttgcgctggtgtggggtgagcttggtctgttgggagagtatgcagttcattggggcctccctggctccaggtttgcatgtctgaggagtgggtatcatcagggcctggggcctctccagtgggcatgtctgaactctcccagggttgggagcctgtgctcatcacaagctcaaagcactccatttctgctaccatgaagtcaaggatggtgactgtgagccgcctgggacctgagctgcctgggactgtgactgaggcacccggggtgcctcttagggccttgggtttgggcccatggctagatgagccttggtgattctgtggtattgcctgggccaggtggacccaggggcagctgcggctagtccatttggagctccttcaagccgaagcatccaacaccagtgtctgtgaggtgtgggcccggccccaggagcggggcctgggcagccccgtgtgttgaggaaggaaggcagggcccccgctccccgggcctgaccccactgcttcagccccctcctgcctgcctacagcctggcctcgagggcccatcagatggagtctcactgtagtccagatggagtgcaatggcgtgatctcggctcactgcaagctccgcctccccggttcacgccattctcttgcctcagcctcctgagtagctgggactacaggtgcccgccaccacacccggctaatttttttgtatttttagtagagacggggtttcaccgtgttagccaggatggtcttgatttttcgacttcatgatccgcctgcctcggcctcccaaagtgctgggattacaggcgtgagccaccatgcccggccaagcacttccttgaacacagaggtgaccatgaggagggaggcgtgaaccaggatgacggggcagcagatggagcctgcctccctgagacctcaggtgaccgagtgctggactgcctcctcctgcctacatggctgagaaataaacttctttttcaaaccactgtgacctggggttttctgataccctcagcaagcctgttcctgtggcctggtgtgggtcccctgacctgtggcctgggctgcctgtatccggcctgcccctctgctccgctgtaaacctgtgatggcagtggaggggcttggcctgggcccgccccaccgcgaggtcttcccctctccgagttctgggtgtggtttcagttgagccacgccgttggactgggccggcctggaggacagaaggcacaggctcttccacatacctggctcgtggcccatgggccgtctgctcacgggagccctgcaccaggccatgcagagcagtgaagtcaaaacctcgtttcccaggtctaaggtgaactgggagcagggcaggagttggctctgtcagatgccacagttgtttggggacagtgtccgtagagaatgtgtggcccccctccgtggtctagggtggagcgtggataggccggtcactcctatccctgggcccaaggctcttttcccctgccctcccgtgggctgggaactgccacagctcagacaaaaatcggccagggcagggtcctgaggcttcagtcccaggctccttagggcacccctggtgacccagctccagcactgagtttccagaggccttgaggatttccctgggatgccagatgggcccttcctgctgctcctggggtcatctaagctccaggcttgggtgcagccctgggcccctgccacagacgccctgaatgcacctgcccctcccggtccccacgcagcagcctcctgagctgcggatcattttcctaagaaggcattctacttgtgccagtccttacttaaagacccctgctggtgctggcagcgtgctaccgggaaggatggtatctcctgtgcgtgtcctgtgtacgctggcctcacacgtgtgtgcctcatgcgggctgtgccctcagtcctatacgctctccccaaccctcttttagggtgtcacaggagaaaaatgacacattcctaaatctctaacacatgggcttgaaaacaagtctgaggatgccctgcagaagggccatgggcatggacatggagctgggtggcctcgtgcactgacctttccctcttcctagccccaggcccgacctagaggccacagcccctgcggacaggctgtggggccagaagggcccacttcagaacttttctcgtgggcagtgtttaggccacagccacccatgtgtaggggtggctacacatgggtggctgtggcctaaacactgcccaaacacgttatattttttataacatggaactagatggcagaagtttaaagggaataaaagagctactggagacgatttgcagctttcataaatttccagagactgataaaaacacagacttgaaattgtcccaaatgagccaaagtgatgaaaacaagtcttttctaaaactctgaattctaagggaatgtaaaatgcagaagttcaaatcgggtttagaaaaccataagaaataatagtgcattcgccgggcatggtggctcacgcctgtgatcccagcactttgggaggccaaggcaggtggatcacttgaggtcaggggtttggcagcagcctggccaacatgagacctcgtctatactaaaaataaaatttagccatgcatggtggcgcatgcccttagtcccagccactccggaggctggggtgggaggattgcatgagcccaggtgtttgaggctgcagtgagctgtgataccaccactgcactccacgctgggcagcagagcaagatcctgtctccaaaagacaaaacacaaaacagtgcataaaaaggggccaggcacggtggcttatggctgtaatcccagtactttgggagtctgaggtgggtggatcacttcaggtcaggagttcgagaccaggctgaccaagatggtgaaaccccgtctctactaaaaacacaaaaattagctgggtgtggtggcgcgtgcctgttgtcccagctactcgggaggcagaggcaggagaatggcttgaacccgggaggcagaagttgcagtgagccaagattgcgccactgcactccagcctgggcaacaaagcaagactccataaataactaaaaagggagctgatgaggagttatttctgggaaatggcaaatgcccacgggtgaccctgatgccagcagcttctctcccaccagacctgtgcttcccacacagccccacctgctcttgtctttagactaagagcctgtcaccgggcgttgatctagccggctttttcctttgtgttatgggcctgttccttcacctcagtgtattctctgcgtgtgctcccttctgggaaaagcaacgtcccacgtttgtgtgattgaaatgtgaaaggagagcctcatgtctagattgtgggcgagtgattgagccctgtgaccgctcgcgcgtgtgacccacagactgtgactgtgtcccctcagcatttattttctggatggtcacaacgtattcaatgtgtccttgagacagccacccagcccttagggtggtccctgcgtgtcctggggcgggcgacttcctgagggtgcagtgctggaaacagagactgcttcgagcctggccaccttccctcctgtgccggctgcttctaggagatgctgtgggacggtgcccggcttcgcggtgactaccatgccctaaggagcagagcctccaggatgcccccgggctgcgctggacgctaagaccccagcacctaatcacagtcagcagcttccctccactgacagtgatctgcatggtccattcctggcggcctgggggcctcgctacagttcaacctggctggcttcccgcttcctccccaggggagattagtgtcgtgtgtaaacttggacaagtcactgggtcctctctccagggagtgcctggagaaattcaacccccagctcagctgcagcccttcctgggtcagctctccacccagagaccccggagcttgcccgcagactgcccggcctgccccagctctgggaaagtgaactccagagtatgcagacatggagatgcgcatgctgatcctgggcatgagggctgggctgcactcgtccattctgtgcatactgccttgaatttttcatatccatcatagaaaaaagtgattaaaaataaaggatgagataaacttggagagagaggatgtaagatgggccctgcttgcccgtcctgtccctgcctgatggcgagacagccgccacccctcatcgcccctcctctgcggtgggcggctgcaggtgggcgaagctcaggaagacctgttccagcgagatctggctcacggagtagtcgtccacgccgtacttttccttggctttctccagaataccgaaaacctttggggagcagaaaagtcactggtaggagagaacagggcccaggctcctctgcgggacctgggagtcctctggcaataggggctgatgaggcccccacaatcctacccctgcccagcgccaccccagagccccagagaggtcagccctgcgacggcaccgtgctcccaggtagaggacgctggctaagcaggagccagcggggatggggcccagcctcctccctgtgctgttcccagctcagattacaaccttgagccagtgatgttccctttctgagccagttctttttttcccccatatttttttagagagagtcttgctctgtagcccaggctggagtgcagtggcacaatcatagctcactgcagtctcgaactcccaggctcaagcgatcctcccaccttagcctcccgagtggctgggactacaggtatgcatgatacctggctaatttttaaattttttgtagagacggggtctatgttgcccaggctggtctagaactcccaggcttaagcaatcctccctcctcggcctcccaaagtgctgggattatggtgtgagccaccatccctgacccctttcctgttttacactgaattccttttaccactgataattttggatataaaacccccaaaccagcacgtatcaggctgagtgttaggggagaaatggaaagtgactcctctgtggaaagagcctgcagtcaccacagagggagagacccctggagggacctccccctgccccatgagtgcccagtggggccccagggactgcctcaccttcgcccagctgaggtcacggcccggcaggtggtaatggaccatgccttggtgctcatcttccaggacgctgcctgcacaaaggagagacggtgttgctgtgagcgccgggctggaggatcggggagggtgcctgggtgctcagcactggagtcctcgtcccagggattggggagatgggacttggcggggcgaggcacagacgctccgcacagcagatgggagaggcctaggtaggggcccagggcccacccagtgggggctgccggggccggcacacacctggaaaggtcaggtccacgaaggccttgaactcctccagcgcctcctgttgcccttcactctgcaccttggcccgcagggagtagccgctgccgaacttgctcttgaggtgctgggggctgcccaggcacttgaactgcccctgcaccatgatggccagccgggtgcacagggcctcacactcctccatgctgtggagagggcgggacctcagatagggcttggggtgccaaaggcttgtgcagacaggaaggcattggctctccgatcaggctgttcctgatacccatgctcagtgtggctcacgggcagactctgcaccagatgctgatgggtctcctggccacctggctcctccatggcccacccggtgctgaaacttccagtaacccacagacccaggctctacctgtgggaggtgatgatgatggccttgccagactctcgggctcgtgccacggtgtcccaaagcaggcgccgggccacggggtccatgccagtggacggctcgtccaggaagatgacagcaggctctccgatcagggcgatgccggtgctcagcttccgcttgttaccaccactagaggcaggagggtgccaggtgggggaataaggctgagagttagcattggctcccatgtcccagtggaggcccgtgtcccagcagcggcccacacccagcaattgcagaacagccctagtgaagaggaaggagctgtgtgtgcacctggaaagcccaccgcatagggctggaggccccagagaaggctgttcccaggggcccggtgcacgcacctacatgggaagacatctgcctgcacctaaaggggacctgccgaccctgacatctctcactgctggctttgtccctaggtggcaggcactgtcagggcagtccctttcctacgtggagctacctgggtcacaccaccacatcccagctccatcctggagccacaagcaggagctctggctgctgacctgagcggtcactcccagctctatgctatggggaccttgattctgactccactctgggaagggccagggctcgggaggtgcacctgtacgtcctgaccagcttgttggcatgtggctccagcagcaggccccgcagagtgttctccacgcaggccccgatgtggcgctcagggatgccccggagccgagcgtacatgaccagcatctcccggcctgtcatgtggtccagcaaggcatcaaactgcgggcagtagccgatccgctgccgcacctggggtcggagcatagccggggagggaggcgggttggagggaagcctccttcctccagaggaccacggggactacccttgaggtgcccaccactgcgcctgtctgtggttcctgccagtgtgtgtacacgggggcgctggagctatgcacaggccgtggtggctgcccacagtggaagctcttggaacagggacacaggaaggatgtgcctggtgcagggaggcttccagagctgctctcagagcctggtccaggacaggcagccatggggttaggtggtgcaagaatggcctttacgtagaagcagactcagagctggctacccactcattcacacctgggacatctgatgtgctaggactctttcttctccctctaagaagaaagatttgtgggcaccacgtttggggtgagtactgcttggtcagatggtgcagcagctgttctctgcacaagtgaccacgtccagctgaattaagacgtgcctgctgccatctgcttagctaccttcagcagctggtcgggggcaggagtgcctgggttctgtggattccagagactggatttctttttctttaccttccttctttggggttctcaagcttccagaatttttttttttttttttgagacagagtcttactctgtctcccttacactggtagagcgcagtggcatgatctcggctcactacaacctctgcctcccaggctcaagtgattctcatgcctcaggctcccgagtagctaggattataggcacctgccaccatgccctgctaatttttgtatttttctttggtagagacagcattttgccatgttggccaggctggtctcgaactctagacctcaagtgatctgcctgccttggccttccaaagctgggattataggcgtgagccacgctcccagcccagaatctgtttttaatcagtttggggaaagtcttagccactacctttttggctactaccccctgccactctctctctctcttccttctggaactcagattacatgtactggggacttctcaccctctcctccattgctagatcacatacggttttctctcccctgcatagattttcaattgcataatttatttctgtagacacagtgagtttataatcttttataatctggcctgatgatgcagatctaacgcctatgtgcttgtccccccatggggcctgtgtctattgcttccagccatggtaccatctcctctgtttgtttgctgtgcattgcctgtaagccctggaaccctctatgggggagtctgcagcctaggatgaggctttcctcccgagagggcctgcatgtgctctggcccagggcctctgctgtccaggcacccctggtgtgagctcaggagaggactccgcggccacttctcagccccaggccctgcttaccatttcccctgctctgcttggcacacttgaattcccatgcaggccccgggcagaggtgcaggagggctgcctctggtccttctgcgggggagctggtggggctcagctcaacatgggaaagctgggcgggcccagggccttccatcccttcactcagcaaggcctctaaccccacacctgagctgcctggacacagaatggcctctgcacagaggtggctgtcagtgctgaatgcgcctctctgggctcacggatgttggcacccatctctctcccctcccatcacctgctagttctggcgaagcttagctttagctcattaccttgtctcgctgtccagaggcatgtgctgggcccatttcaagccacagatgcagcagctgtttggggacagcatccctctgtccctgcctccagggtgccccctccagccatgcctgtctcaccccttcagagcctccctggctgcacccacctttccgacatcagagctgattctgtgacccccgacaaaggcatccccagaagtgaggctctcctccccggtcagcattttgaaagtcgtggtcttcccggctccattgaagcccagcaggccgaagcactcccctttctgcaccgcgagggagagcctgtccacggccaggaggggcacccgctgctcgtacacctgcaggcacccaacagaaaacacggaatgcggaggcctggacgcaaagcagagcagtctgagcctcagcgccgaaagcttccagggatggggtcggaccctggggac

SEQ ID NO: 5948 - DNA, 1026 bp, Homo sapiens
agagcagttgagaaaattgtttattggtggcctgactctgaaactacagatgatactttaagagaacattttgagaaatggggcacattcacaggttgtgtggtaataaaagacccccgaacaaaatgttccaggggctttggttttgtgacctactcttgtgttgaagaggtagatgcttgaccacatagcattgatgagcatgtagaggaaccagagagctgtttctagggaagattctgcaaagcctgctgcccatctaacagcgaagaaaatatttgttggtggtattaaagaagatatagaggaatagaatttgagagaccattttaaaaggtatggcaagattacaaccacagaagttatggaagacaggcagattggaaaaaaagagaggatttgcttttgtaacttttgatgatcatgctacagttgataaaactgtcattcagaaacaccacaatattaataggcataacttggaagtgaaagagacccattctatacaagagatgcagtctgctggattgcagagaggtcgtggaggtggatctggcaattttatgggtggtagaggaaactttggagatggaggaagtaattttggctgtggtagaaactttggtggaagaagaggctatggtggtgaaggtggtggcagcagaggtagttatggaggaggtgatggtgggtgtaatggatttggaggtgatggtggcacctatgatggtggtcctggttctagtggtagagggggctatggtggtggtggaccaggatatagaaaccaagggggtagatatggtggtgggggatatggtggttacaatgaaggaggaaactttggtggtggtacctgtggtggtggtgggaacaataatgattctggaaattatagtgggcgacagcaatcaaattttggatccatgaaagggggtagttttggtggaagaagctcagacagtccctatggtggtggttgggtctggtggtggaagtggtggatatggtagcagaagtttctaa

SEQ ID NO: 5949 - DNA, 4434 bp, Homo sapiens
catctgctggggatgtaggtccatgtccttgacccaagaccttccctcattcctgcccccatccctcctcaagccatatcccttacatcccttgagtcctccatcccccctcccccatctccctgttcacagcctctgcccctcctctccctaccctgtaccacccccaccccaggtcttcctccatctccttgggaacacagagctcctctagcaggcactctcagaacacagcctgccggccccagcacccggccttgctcccagcctcttccctctgtattcagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtgtgaggactcagcctggatcacctcctccaggacaagaacaacctaccatcatctgtccgtccaatctacccacccatccatctctgcctctggccatgcatccgtccgtccatccatccccgcctctgtgcatgcatctgtccatccatccccgcctctgtgcatgcatctgtgcatccatccatccctgcctctgtgcatgcatctgtccatccatccccgcctctgtgcatgcatctgtccatccatccccacctctgtgcatgcatctgtccgtacatccatccctgcctctgtgcatgcatctgtccattcatccctgcctctgtgcatgcatctgtccatccatccatccccgcctctgtgcatgcatctgtccatccatccctgcctctgtgcatgcatctgtccattcatccctgcctctgtgcatgcatctgtccatccatccatccctgcctctgtgcatgcatctgtccattcatccctgcctctgtgcatgcatctgtccatccatccatccctgcctctgtgcatgcatctgtccattcatccctgcctctgtgtatgcatctgtccatccatccatccccacctctgtgcatgcatctgtccatccatccccgcctctgtgcatgcatctgtccgtccatccatccctgcctctgtgcatgcatctgtccgtccattcatccctgcctctgtgcatgcatctgtccattcatccatccctgactctgtgcatgcatctgtccatccatccatccttgcctctatgcatgcatttgtccgtccatccatccctgcctctgtgcatgcatccatacctgcctctgtgcatgcatctgtcagtctatcaatccccgatcccttctttgtaatggtgttgagcgctcacaactccctcatcctaagacgctcgttggatccattccctcccctcaccccatgctgctctctgccctcccttcccggtcaagttctccagccagtggtctcaactcaatcttcacttcccccgctcctctcacacctatccccactgcattctaaattcttccccaacgcgctgggcctacaggcactaaaaaggtcactttgtccctggatgaccaaacacaggccaatgtaacttactgggcttgttttgccccagccacagctgaccacttcctccttcactcttgttgttgatcacctttgggcttagtctttctccatctctgttgagtccttctcccctgccacctactccttcatgctggggttctctgtagctctgtacctgacagtcacgttccaccctttcctcccagaagctcgccaacccccgtggactgctggctctcaaggcggccgctagcccagctccgacagcagctgacaatgcacagtatgcggcccagggcaggccctgtgctgagaggcatgggtgaatggctcatttcatcggcaagcccacgccaccagcaggcgccgttctcctcgcatttctcaggcgaggaacctgagacaatgaggttaaggaagttgttcattacaagtggaagaaccctgacttacttgaattcagctttgaagcccacattctctttttctgtgtgtgtgacagggtctcactttgtcacccaggccgcagtgcagtggtgtgaacacagctcattgcagtctcaacctccctgactcaagcaatcctcctgccttagcctcctgagtagctgggactacaagcatgtgccaccacgcccagccgaagcccatatgtgaatgttgaggcacacagcctccccagcctctgccttaccaagccctccacagggcctaggcaccctccctggctgcccccttcccccgtcactcaggctccccagcagccaatgtagttaatatggggctgcaaagagctgggcctggcctcaggcgggaccgcctccccggcattgccatccctgctgcagagctcccatgcgatcagcctcctctccagctgagaccacatcctcactcagcttctaggctgttcctgctccccattcccctcagcacatggcccctgagaaactgcttgcacaagaatttccctctggagccccacctctggggaacctgacctcagacagaggagaccaagctctagggcaggatcctccacctcccttgccccaccggtgtggccagcccagagcgctgcagactcccgcccagacctgcacttgtgcctgccttctgccagcctgctcctcctcctcccactctcacacctgcattaacagcaccaggacgccatcctccaagggccccagcctcatctcccctgtcaccaggatccagccagatctcaatccttgcccatcctaactgaacctccctcagatccgtccactgcccccttccccaggaccacactccaccatctcttgcctggaccctgcgagaacttcctgcctccctgcctctatcctaccccctgccccccgctgaagctgatgatagttccggaatgcaaaaccccttaatgattcccccattgatcaaagtcttccacatgctttcaaggtccttggtgatccaggacctgccgccttctgcagtctccctactgatgccatagttttggcttctggcctcatatgtcccgggtcatttctctggtcactggctcctcttacccctgactcagctggctcactgctttcccattggatctcaaccctgtgtacctggggagagcggaactctgtatgtcttgtcttgtgctagtagtcactcagtgtgtatgtgtggatattcatatatatatatatatatatttgagatggagttttgctcttgttgcccaggctggagtgcagtggcacgatctcggctcactgcaacctctgcctccaggattcaactgattctcctgcctcagcctctccagtagctgggattacaggcttgcaccaccacacccggctaattttttgtatttttagtagagacggggtttcaacatgttggtcaggctggtctcaaactcctgacctcaggtgatccacccacctgtgcttcccgaagtgctaggattacagatgaaagcaatcacgcccggcctatattcatatatatattgagggaacgaagtcacctcttctaggaagcctccccttgcccaagagctttgggccaacatctctgagcccctgcaggcttgaggacttcctctgctgggattctgtggagctgtgtcaccgtgggtgttgtcattgccagtcactcttctgactcagctgccaggtaaagatttgttttcgtctccgcaagcccccagctctggcttggagctaggcacctgctaggcctctgtgatggttcattgtgtgtgtcagtttggcccggctgtcgtgcccagctggttggtgaaacaccagtctagatgccatggtgaaggtctttgtagatgcaattaacatctacaatcagttgaccttaagtcaagtagatcatgctccatagtgtggctgggggtggggtgggggcagagccaatcagttcaaggccttgagagctaaagctaaggtttcctggagaggaaggaattctgcctccagactgtcactgaaatcctgagttgccagcctgccgtacaaattttggacttgctatcccctacaatcccgtgagccaattccttaaaataaatctctttacacacacgcacacacacaccccccccacacacatacacacacacacacatcccacacacacgtgcacacacacacacatcctgttggttttgtttctctggagacctcccagctgataaagcctccatcagtaaatataatttaaacctaa

SEQ ID NO: 5950 - DNA, 1581 bp, Homo sapiens
gaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaac

SEQ ID NO: 5951 - DNA, 395 bp, Homo sapiens
caaacacaaaacaacgatgtacaacagaggggaaatatgctcttggtcaactgaccttgcagaaaagactggcttgtttccaagtggatgagaacgccagtgtgtggccagagtccagcaatgactgaccggcccaggtcagaggctggcagggaccacagaagggccaaggcgctgccggggctcatcccaggctccaaccccaacctggaagcttgtggacaccaggctctgtgcagcagctccgtggctagcgtccagggcccctggccactactcccaaatgcttctagtccacccacccctggccagccccaaccttgacatcactgtggatgccatcagggtggtctggttcacttatacaacatgatccatgggaaaaccccttccgt

SEQ ID NO: 5952 - DNA, 1039 bp, Homo sapiens
acaagggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaaggcactgtgagccctgagatgttcaagaagatgtccaactcagagatcatccagcacctaacagagcgtttaatgaggtggaagaagatgaccaggatcctcttacccctcttatttcaaaacacaatgcctattatccccttctttttgattctgtgaaatagggtagcttttagaaggtggagttcagtctcttgggggtaaaagagatctgaatatgcctctcaaactggggagacagctaggaaatgaagcataacagatatttttactagactgttgggttttgacatccaagcccctatgacttcatatacctggtcataactttcccatccttttcatacatccttttgtaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagag

SEQ ID NO: 5953 - DNA, 8242 bp, Homo sapiens
gggcaccttggccttcttagcctgcttcccaagctattctcatcagtggcctgactgcaagggctcccccagggaaaacagaagccgctgctaggatgataaggataaaacataattaacatggcctaattagccagcaggcggctgctcctggggcccagctgcctgtcctgctctctctgccttatcccagccccttggttgacggtcgcctcagagaagccctggatgaggctgaagacacatctaacaaggaggacacagcacagcacaaatgcacaccaccacaggacacaacccgatgacagcagacaaagagaggccgtactcggtctttgctggcgcaggcgaaacagagctgtctgcagtggaaggagcaagctcaggggcttgtccactggccccagcggcgggagcaggagagcccagggctgcaaaaacatcctttgcaagggttccaaatggagaacgtgcaatgaaaggaaaggcaccagctgatggcgcagggtggtgcagctgctgggtccctgggctggagcagagcccaaacctcagcaaggtggacaggtctgcactcacgagaaggcggccttgccctcctccatgtccttgcccttggccccgggcccggcttttccacacaggttgaccgcaatgcacatgaacaggccacacttgttcaggaagtagcaggtgatgtccacaaccaccaggagcaggacgaagatgacgatgaggatgcccacgatggccccggtgctcaggcctgaggtggggctgccgttggcttgagtgggagagagatggctggtggttaacagactgagatgcgagacctccagaccctgccagcaaaagcccctgcgggtggggagggcccagaggacagagtcatggcattcatgcccagagtgacaccttcctggggaccttctatgccccagaattgagaaaacagggtctttctataccttccagagggagggatgacaacatcatctcacagattggggaacaggggtgagcctggtcagctggcctcccgtgagtcctgggagcagactgagccccgcctgtctgagaacaccggataatgaggcagttggagggcgctgctgtgtttcccctggaccagggcaaaaggctttgcagcacaggcaggcagtgatcactgatttcaggcggggctgtggctcctcaagtgctcagggataggggcccaaaatggggtggtggagggttcctggggctttcttggggcttgttgggttgtccatcacaatagcatccccattatacttctccacttcctctttccctctttaggaatgaccccaaaggagccctgcattagagcacactgggttcatagtttaccctcctcactgcaccccaggaagacaagtgaagcctgggtgactccagagacatggaggcctccccaggccatgggcaaggtgaaaggtctgggaatactcaccatctaggagctcaggcctgcttggaccagacttcaggaaaacctgaagtgagtgcagactcactcagaggtgcacacacacacaggcacactcacacgcaggataaatgcccatgcagacaggcatgcactctcacattctagcacctggcaccctggttctggctggactcactgtgaaagactcagcctgtgtcttacttccctggtgcccatctgcaatccccccagggtctttggctattgatggtttcacagagagacctggactcagctctctggggcccctgggagatcaacccatggttacgattgacactagttgcctgggatggaccaattgacctcttggtggttcccatcagtgtctgggagacagtggtcatgatgcaggaagcaaggacccatgtggagctctgccattaagtcgatgtgggaacaatcaccctcgactgaaatatgggcacttctaattcatctttcctccagaacaacctgcttccataactggcagccctgccccaccagtagactatgtctaaagcttcctgtgctctcagggccaactgaagccacccaggactgcagactgaagatgggaactgtagccagcactacctggggctcaccccaccagccaccccactcccaacccagctcgctaggctttgccaagcaccaggccaggctcagcagcttgcgagccatgtaacatgccagatagatagtggagggaacatgtaactgagtaaccagcaccagagctgggccacacattttttgtttttcatgcagcctgtatttgcgggagggtggtggtattgatggctctgtgtgccccaggggtctctgtccaggcactctagtgcttctctggtggctgtccctctccactggtccatatttcaaacttcagtttggggaatgggccatcagcctagcatgccagagaggatccctcacaaatgactcctgagacccctgggtgcagctcgtacatgtttttagtccctttgggaccttggcttgcctcccagcccttcctcctcaggctctctggctggtccctgctgacctcgcactgaagatcctagcgcattcccccaggaaggcttgagatggcgaagaactctgcttggagaacccagctctggacacctgtctctgggctttggcagcaggaagctggccactggccttagccgtcagctagaatgggtcattttcttagcagccatgaatgcagaggtatttctggttagtctcataagaacaaaaccatccacttccccagagtcctcacacattccacccaaaaagcaaaggagacacaggccttcttggtcttcaggatcccatagctgtttccctgaacagggaagaaactttagccttgggttttctctccattccatgacacagggctccaggccactgcagcttccggacatcagtacccgataggtgtaaagtgcctactccctgaagaaagatctgaaagtatttttttgatgacagtggggaatatgtctggatttttggactcaatggcactaattatatcttctgaggtttatgtgtaaatatgattttgtgaaactaatcatatctctaaagaggaaaaataaactcctgcaaagctgctctatgtgcttgagaggacagcagctgggacaactgctctgtgctcatcagacccagctggagggcggcactggcactgcgcacatccaggggagggccaggcagggaaaaggcttctgaactgtggcataaacaagtagggcagcggcctcccctttcatttgaatataaaattcaaagtctttctcccggcctaaaaggcccaccatctgctgcagactctgcccactcctctgttgggcctcatggcgtgaaccggcagcctcccttctgcctgctgaacacatccagctcaacccgctttagggccttgatgattctgtgcctggaacactccctccagggtggctctctgttgtcctgcaggcctcagtcccagtgtcaccttctcagagaagccttatctgatctcttatctagtgtggcacctccagccaatacctaccatgctgctagcctgttttattctcttctaactactatctgccactttctgttcatttacatgcttatgatctagccatcccccctaggacatcccagcaggtaccctgcctgtctctcttgtatctccccagcatctaggacaatcctgattcacagaaaatgttcaaagaatacttgttgcacaaatggatgagtgtttagtctggagacgagaatactatttccaaatatttaaaggtgttataaccagaaggaagaagtagtcttactgtatatggcaccaatgtgtggaaattatggtggtggcagattttagctccatctgagaaaggactaataaacagggcgaatccaacatagtgtgggctgctctgagaggtgagttccttgatgctgaaggcactcgagcagaggccagaagaccccttggcagggacgctgtaaggctgtggatgaggctcccacactgggcaggagcatgggtggagagtgtctcttcaaccacaagagcctgtcattccaagtcatacattctacactgcctggcacacggtacaggttccctaatgccagtctccagagtgtggactgagaaagactttttcctggaagaccaaaatgctcggtaggtcccatatttaatcactgatccttgtgattttatttttgcatgacaaatacctttaaactcaatatatctccacctgtagcaaattcctagggtgtttgttaacaattcagaatctggggctccccacttttatgggatctgaatcactgggtatgaggctcaggaaacaggagttgaacaagcagcccaggtgattcttatgaggaccacgctcctaggtcttccctcccctgcattacaaagaggagcacgtgatcccatgatttgccaccccagggtgcactgtgctgtctcacccagtgaccctgaaaacaaacttgacctaaggtattgagtggatcaagagaaaacaaagagtatgccccaaaggaaaagcgaccatactgtatgccaacactgagtctaaactcctcaagcaggtgagatgctctttaagctaggaagagaatgtttgtggcttttacaaaaaagaggctgtgaagaagggacaggctgtgaaatgggcagcagggtattgaaggcgaaagccaacacccattccctctcagtggctatcacagaattgtttagtccaagataactagaagaacaaaggccatctcctgcctcttgtgtaatatttcataaaaggaaaaatataaacctccatgggtctgtctttgctatggtcttccctcagccctcccttgactaactcacctgtgcaccttggatgcaaagaaggcttctggggaagagtttccccataacctcgaggtcagagctgcccaggacagggagattatgaaggtggagctgtccatcttctgtgattcctggcttgggaggggttggcactaaagagggaactggcttgctccaagaatgagacccacagatgcctatttttgtatgccttaatataggaacatgggtctcacattttataaatatccagatgggcctgagtccttgtgccatgagaccctggtgcagcagaaatgcccttttcacccccaagactcccagaagatggtcagactcttggaactgttgagctggggttctggttcactcataagccctttacatgtctgcttgctccttcgaatcagctaaacagatggctggtctcaggggcttgcaggatgcgtctgagttaagtgtgattatgaatagaatacagtttgcaaagagaatcttctctcagattccctctccacaagctcactctgtgcagcctctgttagggatagtataaaggctgctgtgtcatcaggtgaccttgccacagagttgtgcatctgttggctcagagtgtggccccatccccatagtgaccacctccccagttctgcaaaggcattttcccctcccactgcctgctggggactccaaggcagcaatgcctcttaacagctcttaggatgcctgggaaaaagagattgctccccgttaggaagaaaaagtatttcattcaccaggctactatttctctaggtaatagtctatccaggtacatgagaggcggagggaaagggtctttgctgctttgtcagacacaactattgaataaaatcaagccacgctggtgagttcacatgaactgttatttcctttaataatgcaaaggtgtaaacttcataaagccctcactgattatctacacaacaatgttagcattcttattagtagaaaaacatgatccaaacctgctgtataaatagtccaaaaatgagcaaaggggccccatggtgtgtggagcatgggcagcacaactacagggcacaggggagtggggtgtggctgagcaaggtggggtgcactcactcctgcagggtctctgagggctgctgtctccaggactcctggcggggctggggctgcagctgtcaccaggaactcagtgtccgtggggagtgggtatgcgctagtgctgcctcctgaggagcgcactgttacaagccgtgggtctgtctaaatgggacccttgaggaccctgacattgtttcagctgaggcctgcctgaccctgggatgtgttgagatgacagggccacgtcagtcctctccacacttaggacgagatctccaaagggtcccttcagaaagatggacactgcccctctcctgtgggtggtcctgggatcagggggaggcagactcccaagctgggccctcctaggatgaagccgtgtgacttctgcccaaggtgatcctaagagccagtagctctcccacactgacctgggatccttatgctctgccctgtgcccaaaaaccatgcctgcctccactgccctggtgtgaagcgccatctgggactccagcggggagagttttgtggctgggttgagaggcactaccctgcctgagctactgtgcagcatggagcctctgatgtctgcacgtgagcctctaaactgagcgctggggattaatggcgagcgccaacataggtggctttgcccctcagaccacagcatgggatcatttggaatcccaaagggaaaggctagtctttgaacattaaaaaataataacaacagaaaaaaatacataaagaaaccaaaaagaacaaaaatcaagcttccatggagatgctcagagatgagatatgtagaatgatatgtgaccacaatggggggagggagggagtttttattcagtagaaggtccatccccaagcacacacactgatattaccaagcaggattcagccctgagtctccacaagggaccttaacaaaacacacccatttcctctcctgggtgaactcccaagcagcagggaggagcagctggattttcaggagagtttagaaaatgtcactgaaccaacgcaccaatacagaggctggggcattcaggaagcactgacaggttggctcggccccaatttattaaccctcctgggctgggcagtctgggagtggcctgtccctctccttctctactgagcacacacaggccaggtaggggactaatgcctggttcacagtggatgcttccaacctgtcctgtagactgatgctcaaagccattctgtgggtcactgctgaaccacggccccactctgtgctgatctgcgacatgctgccaggcagcaggggagtcaccccgattgggagacaaacacctttcaaagctgacacttgttggcacatcatggcttggccccgttcacagagacagtgtaaggtgctggccgtaatacgaggactgaaagcacatcccagaacgttcatcagccccagaaaatatccaacaaattcaactttttttccagtgcatgggcaacaggggtgacttcagttgcccatcatgtcagcaaaacgctcatgtgaatcagtgcggtctggctcttttaacatgggcacttaaatgcttaattgcaagcaaagccaattattattgaagggaggacaaggagcacagagttagaatgaggggaatgtgtggtgattttaacaatctgacacaagctttagaaggtacttagaattcttcctctgctacatcatatttaggtttgaacccaaaatgcaacaagtagcagatatgcagaaacttctctgtaaatctagcatgatggtttttaaaaatagcatttaaagaaagagctctcaaattctttttactgccattaaaaagggggcaaactccttatgaagtggcacaaaagtatctgtgagtggtgacatgtctggaggtaaagctttttccaatcacaaaaccttctcttccacacagaatggttgctcagcagctgtggccatggtggtcctgccaggttcttccaaagggggcactgatctttttcataggaactgggcttttaagcaaatttaatttttgtgttcaagttcctaacagagcaaaagaagagtcactgcagagaaaagcaatgagacaaaggtgtaggatgcagaattgcctcccaaggttgctgcaggtgtcaagcaatgggtccccagagataatgtggttgtttaaaaacaaatgtggcagtggggatgtcccagtgacgtccaaggtgacaagtgtgacgacagacacagg

SEQ ID NO: 5954 - DNA, 1400 bp, Homo sapiens
catggcagtatctgccaccacttgttttggtccaagggcagaaatcagcatcctggaaaccaatcagtacttgcgctctgaactggaaaagtgcaaacagaacttccaagacctcacagagaaattcctgacatccaaagctactgcctactccctgaccaatcacctgcagaaatatagatacatgatcccttaattcaggctcaggctgaagaactgacccacttacgacagaagacacaggaagggagaggtgtctgctacctttttacccagcatgtgaagaacacagtcaagtcttttgagggccttctcaggaacactggcattgcctactaccagagacagagattctgtgagcaaatggtacaaggaagccagctgacagagatccttgtcagaaaacttgtcacagaatcttgctctcttacccaagctggagtgcagtgacacggtcttggctgactgcaatctgtgcctcctgggctcaagcaatcttcccacctcagcctcccaagtagctgggactacagaatcacccccaattctcaccaacaaactgagaagaaaaaaaaaagaattacccccaagaacatctgaggaagcacaacagggacagacttgaaggcacctgggcagtcctctggttttggagtagagaaaatcacaacggtaagaaaaatgaagacaggcaaaagccactggctcctagcatgcacctctaaactctacaggcacatcatagattccatcgtccagctgtataatgaaaacagagttctcagagaacaccggagactcccccgacttgcctgaatcaagtttctagaggctgaagaggaggaaatacaggatgtattggtcttgctgttcagggtggtagaggaggaagaaaatcccagtcgtctttgaaattcacagagaatatgaaaagcaggttgtcctgtacagtatctgcaatcagttacgatacagaaataacttaaacatgtcaagaaagatgaatgcagatactgtgaggaagtgctaaagtacagccaagatcatctcatgctgtacccttaccatctatcggatattatggtgaagggcttgagcataacaccattttcatattatactgggattatggagaatattatgaacagtgagaaaagttatgactcattgcccaattttactgctgctgactgtctaaggcttctcggcataggaagaaaccagtatattgatcttatgaatcagtgtagatcatcaaaaaaattcttcagaaggaaaacagcccatgatcttctaccaataaagccagtggaaattgccatagaggcgtagtgggtggtgcaggctggatatatcacataagatgacatcaagatacgcactttgcctgagaaatgtgc

SEQ ID NO: 5955 - DNA, 485 bp, Homo sapiens
atccacactggccaggtcagcaccatatgttttctgagtcgaaaccaagaacgtactcttgcttcagtaaaacctccaagagctatcttttcactaaaaagactgtaacacaaaatcaccatgtcaattaaagtttgcattctgtcgtgtttgccttccatattgtttttgccatgtttgccttctgtattgtttttctgaaagtttacaaatattaaaactgacctccatgacttgattgtgctggaaaatatctgcactgtctagtggggttttagaatgtgaagggcaaagtacttacaggaaggaaattgtaagttttctctccatataatctattagcaagtttcagaatataagacgctccacgtttgttgatatcagcattcagactctggaatcttgaatgaacctcttcaaccgtgttgaaatggaaagtctaaaataaagaaaatcttctttctacaaccatttattttgaaact

SEQ ID NO: 5956 - DNA, 917 bp, Homo sapiens
aagagcagatggaaatacagagaccctcagagaagagaaggccatgtaaagatggaggcagaggttggagtgatgcgtacaagcccaggaacaccaaggatgccggcatccaccagaagccaggaagagtccaccgaagcattcacttggcacctctccaaatctgggtactgtgcaagatccttccttgggacactgaaggaaaatcagacacggcccttctctcaagttcgcagactctccggtatccagatactacggctctcatagtatcagaaaacacagccacaagcgcaggtatcagcgtgcctggcacataaatggtgctcaataaatacttgcggaaggaagacaagataagcagccaggttggaaagaaaaaaaaatccataaaggaatattgacattaaatgctaagtgatgtcacaaggatttaacctttttgttctctttatgtagataaagtatacgcaattacacgaaatcctacagatgtctcgtagttctcaaaattcttcatttgtttctcctccacttctttatacaactaaatagtagaaagagccaagcaatgtgcacagtaaaatttctactgcagagtagttaaaagtatcactactcagcaatgtactgtactattcaaagagtgctaagtgttttcctctctacccatgacgcaagttctcgctccttctgtgggatgtgatcttggcttccttctttggacaaagccaatccagagcacactgcatcaccacactcacttatcaagaaaaggccaatattatctaatatacgtgaaaataaaacatgaagatatatggcattattttcctttgtgcacaaaaacaaattttttttccaagtgcgactgttttactaaagaaaaccaattattatttacctttactcttaaa

SEQ ID NO: 5957 - DNA, 26588 bp, Homo sapiens
gacagtgcagtttccagacccaggccctgagctgaggggcctcagggctcagaaagggcctaggcctcagatctctggtgagcggggagcccaaaatggccctggaggccacagctccagaactagacccgtggagaatggagggctggggccctgcacattctcaagcagtagtagcaacactgtcattgtcctgcccttggtataagcctgaagaaccaccctttcttacccggcttctgctccccttttccaggggctcctgtgggaaatcccgggtacttcctgggactggtctgtctatatgtttggaaaccacagagctgacctggcttcagaacaagatgtggggctccaggcacccgggagaccagtgaccctgattggcaatagccgcaagaaagggcttggagacaggggccaggcgcggtggctacccctgtaatcgcagcactttgggaggtcaaggcaggtggatcacttgaggtcaggagttggagaccagcctggccaatgtggtaaaaccctgtctctactaaaaatacaaaaaaaaaaaaaaaaaattagccaatgtggtggtgtaagcctatagtcccagctactcgggaggctgaggcaggaaaatcacttgaacccaggagggagggtgcagtgagcagagatcacaccactgcactccagcctgggcaacagagtgagactccatcaaaaaaaaaaagaaaagaaagaaagggcttggagacagggccctaaccctggaatccagatgttgccaaagcagccccctcctgttcctctgtctgcctgggaagaagcaggagttggccacccacacaggcagggcgggcccttcaccacccagctccaccccggaatccaagggcctctgtttgctgctgttttctggaacaacttgttttgatctagagaaatctgctgacaccggccttcctgctctcaccctccagctgggcagaggtatttttagacttatttgtagaggaagagagcagaacccaggcccaatgtgtaccctccttactgtgggcacagctttggccccttaaggcaggacagagatatccatgtggttgtctaccctcagctcatctctccttaaatacattcctttcccgagaaaaacgagctgtgtggaacttggaggccagcaaagcttctacataaggaccctctgaaacagtgcccttttgtccttgaaaacccagggtggcaaaggcagctccagatacaagggcacaaaggagacttggttccctttgtgacagggaagcctatgctttacagaatcctatgttttgtatgtcagtaattgtccctacttaaaaaaaaatctatatatatatatgtattagaaagggtctcactcttgttggccagcctggagtgcagtggcacaatcatagctcactgcagcctcaaaatcctaggctcaagggatcctgctgcctcagtctccccagtagctgagactacaggcagtcatgtgcacctggcttttttttttttttttctttcattttttgtagagacagggtcttgctgtgtttcccaggctggtctcgaactcctggcctctaggcaatcctcccaccatggccttcaaaagcgaatggatcccactcttttttgaaaaataaaatctaccatagtttgtttctgggatttgggaatgatgtgtgtgaattagagagatttcgagacctgaaatagagaaaagcaagttaagacatcaactggggcccagaaacagcactacagcggggacgacccacctctcagatgcctggtgagataaagaaaggtctggctgactccactgcccagtactgtgaagcagcagtgaagactcctccattggtttcataagctgcccagctttctagaacattttgacagacaattccctctttccacacggttctttcaggccaaatcaccccaccccaacccacccctggagatacagtcaggaagagactgatggggcagatcctggaggaggccgcactgccggaatcttcccctggcagagaaacagggctaagcaggcgccagggagcaagcctgggcttgccacatcaccaccttctgtgctgaaggtcagatgacacacagtcaccagttttccgagaagcacagggaggggtgcatgtcaggcccagccctgcctgctgataccacctcacagacgcaggcgaaatgtcttcaccagcttcttctcggttgccaagggggcctgctttcaaggggttgttttgtatggggtgtgggtgttaaccagggagaggttcctggcaggagttcctgtcagatgccattttccattctggttacttgaaccggggtcctttttcatcctctacctcaggggccagagcttcctcatcaccctgcaccccctagcaagggaggtgcccgctacacggtccaaagtcctctccagacattcgggccctgcccgccttgctggagggctcaggagttcaccagggatgcgcattctcaggaaacacgtcccctcgccaggcccctgggaagagtcaaaaccacgatgcctgcccctgaagcgcccgcgcggctccacggggctccatgttgtcacccactagctcctggacgctatcagcccgcagcagggtttcctggccagagaaaccgcctgttggggtgcggagcgttccacgtcccctcgcagcaccccgctggccttctgggccgccccgcccccaacccgcgcccgggcgctgacgtcatcggccgagcccgactcggaaccaccgcccgaaagtcacgcgcgcctcccggcgggacgtgccctctgcagagatccctccgccgccgcctggaattttccagatgtcctgccggcccttctttcgggcctcggctgggcgtggtgacctcaagcgaccccggcggctcccgtcgcccactcaagagggcgcccccgcccgccacgcccccagcccctctcggggaagcgcgtcccccgcccgacctcaacaacatccgggaagaaaaggggtcttcttcctcatggcattcgcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaaggcgctggtggtggcacgtccagcacggctgggccggggttcgagtccccgcagtgttgctgcttccttccagctccctcctccaggcctctcctcccaccccaccagggatatcttgtctcctagaggggtagcattgggtggggcaccccaggcctctcccagaagccctcctgccctgctatcccctccctcatcctctggggccctgggaatacagcaggggacgtggggccacaggcagctgataacttagccccctcagccactcctgtgggagcgggagggggacagcttggcggctctgcacccaaagctgtggggcctacctggagtgtccccacccctcagggcatactccccactgccctcttcttcccaggatcaactcaccgctaccctcctctccacatctgaggaccagcgtggctcttccagggagggcttggggagatgaggtccaaggggagaggccagaaatcctgaggcctgggctggagatgggtgggcggacagggcccaacgaaccggcccttgtgcaggaaggccaacagctgggaccacaaggtgccgggtgggacagggaagtcagcctgtgctctccaggcacctgggacccaggagatccccccggctcagcaccagcagaggcagctgctgtgatcctgggcaggcagtgtcctcctccctcagtctctgccccctcccatccccaagagggaggccaggggctcacagtccatttcatgggccatgatactgatgctgtctgcagttggggcagcttgcctgaccacaaggctctccagggagcccctgccaatcactataataatctcctttaacgagtcaggccccataaggaacagccagaagcaggagagaggggtgagaagaggcagcgtgaagccgaggtcttggccggccatgcctgggtggtgaggccacaagtccacccctgcaactgcaagggcagcagggaggagctgcaggatctgctgtccttggatgtgatcagcctgccactggggaccaacaggcctagactcatacatgagccaaggcacagagcccaggactgaagacagagaggagccaccacacggcaaaagagcatggacatctgagtgccacctagcctgtgtgagactccgtttctctatctctaaaatggagtccgccaggcgcagtagctcatgcttgtagtcccagttactcaggaggctgaggtgggaggatcacataagcccaagaggttgaggctgcagtgagctatgactgcaccactgcactccagcctgggtgacagagtgagaccgtgtctcaaaaacaaaaacaaataaataaaatggagtcactgatagctacctcacagggttgttgagaaaattcgggataacatttactgcttgccacagggaaggtattaaaaagttacag

SEQ ID NO: 5958 - DNA, 4890 bp, Homo sapiens
agtacccctatctgaaatgcttgagaccagaagtgttttggagttcagattttcttttggattttggaatatttgcagaatacctactgattgagcatatctaacctggaaatccaaagtgctccggtgaacattttctttgagcatcatgtcaatcaatgctcaaaaagttcaggattttggagcttcttggattatgggtgctcaacctgtataggaaacgtggagatggagcatgaatcagttgtatttgatacttgctggggaaaggatttccagaccaccagagaagaaggatcacccatttaacttggtgtatccagtgccatatcagagccttttcttccattttaacctcaccagtagtctttagatttgtggtttatgatcaagaaattaaatcctagaatacagattagtagagcaaagttgaggcttttgattatctatttcttttaaggtttttcgctttaacactttacagaagaatttctagactgtctgagaagaatactccaggtatttgtcccagtcttaaaatggttcaacaaaaagttcataatcactttttagaacccttttcccaaagaactgtgatcctacgtgtaacttaaaaaaagaaaacacacaaatgcttgcatcttttttcacatatttatctgtattcagcaatcaagaatagctggtactgatggatatctttacatgatttttcgttatttatctgaaaataatatatattgggtcattatttggcttttcaacctcagtaattcagtaactttctttcagttaattttgttgacctgttttggacacttttcaaaatattcttagcatgattttactgggaagaacacattattacaagagttaggcagtctgagttccacctccatttgtgtccatcctctctcgtttgtttattgaatgccttcacctgtgctctgaattgcatctctttccttctcaggaaattttatacattgtcaattattccttctctctaacttcaacctcgccttctttgctgagtctgacccatcaacagttaaacatgatcaagtcttccgatttaaaagtccctctttcttgacacagctcatttatagccaaacttctttctgaagagtagtctacattcattttctttttctccctcacttctgataatattgaaccaactccattttagtttctgtccctatcattcctctaaattgattaaggtctccagaatattcctctgtatttacgggcattattcactgctcttcttatttgactactcagcaagcatttaacttttgatcagtttttccttaaaatactttacttggcttccttgacatcatggtttttgttcagatctctgtggttatttctgtctcctttgctgccttctcctcttggtccttgaattttagaattcttcaaatttcagttctagacaatcttctgttcttactcttagctttccctatgtggtctcatcatttctcatgtggacatagtagtctccccacttttatttttgccaccttacaattttatccacagagcagctagagtagtctataaattctttttaaaatacgtaaaatcactcactgcttagacactacataatctagtccttggctgcttctctgaccctgtcttataccagtctgcatttactacagtccatctatactggcctctttgaactgttcttcagatatgataagcttgtccttgctaaaagctctaactgttatttctgcttggaatgctcttctcgtctactcttcctatgcctagcattttcttaatgtttaggtctcacctgagatgtcactttcactgtagtactagtagttgatgttactactgattcgttggcagtattcctgaaatagaatataggataaatgaggacatgtttattttgttcacagctgtgtccacaaaatctaaacagtgcctgtagtactgtaggagctcattaagtagtcggctgattgatttttgtacctaatggttctattaacaatattgacccccaaatgtattttcttcataaccttctcctctgaactccagtctgtatatttaactgtctacctgacatttccacttctaagcttaaaagctcctccaattgaacctgtgatctctttaaatctgggactccaggatttcctgccacagtgaatggatttaccttttatctatctctgtaagctagaaagttgagagtcttcttcaatgccttctttccccctcatattcaatccatcaaatggattctatggactttgccacctgaatatctcttgaatctgttcctacattttaaactaccatcatttgatggattttcacacagtgagtgtatctatataattaatacccaggtcaggaaatacgatattactagcaccttagaagctccttgtgccctctctctgtcagagtgatctttttaaagggaaaatgtgatcatgcttaatgcctttcagttgcttcccattgctcttagaataaagaccagaaatcataatgtgatatttaagatcctggatgatgttactgtttttcctatgcaacttcatgttttttaaattatttttctcactttctgtattccagccctgataaccacctctcaattccttgaatgtggtatgctgttccctcttgctaaaaaattctatgtacacataccccttccgttcttgtccttcagatttgagctcttcaaagttttcttggacatagcaagcttgatgaggtcccaaatacatcttatgtgctctcatatgctttattcatttgtatattattatttcccttatttttaagctaatgagtcaggtattacacctgttttgctcactgttgcttggtcatcagctagcatggtggctgggaaagattagtattcaatattcatacaataagtgaatatgagtagtttgggtttgttatgggatgaattatccatccccaccccccactcccacacacagacacccaactgatacactgaagattgaaattctaactgtagaacctagaatgtaactgtatttggagatggggcctttaaaaaggtaatgaagataaaatgaagtcatatgggtggactccaattccatatgagtggtttccattaagaagagattaggacacagacacacagaaaggtaagaccatgtgaagacactggaggaagatggccatctacaagccaaagagatctacaggctttagaagaaaccaacactgctgacaccttgatcttggacttctagaagtgtgagaaaataaatttctgttctttaaactacccaatctgtgatactttgctatggaagccctagtaaacttatatggattttggtattgggaaagtggggtgctggtgtaattaatacctaaaaatgtggaattggctttagaactagataatgggtagaggccagaagaagtatttgttagaaaaagcatagactgccttgaagagattgttggtagacatatggatgttgaaggtgattctggtgaagcttagaaaataggagagctgttgagaaagcttctgtcatcttagaggtatacatatgtcaccttgaataaatattggtagaaatatgaatgttaaaggtgtttctggtaggaactcaaacaaatgaggaatatattgttggaaactgagggaaaggcaatgcttattataatgtggcaaatagccaaattgtgttttgtggaaagtggatgaacttacaaagtgatgaacttgaatgtttagctgagatttctaagcaatgcattaaagatatggcctggtttcttcttgctgcttaaagtaagatgcaagaggagagagagaaatttaagaaggaattattaagccaaaagcaaccagagcctgaagattcggaaaattctcagtctatccatattgcaaaaatttagcatgttctggagggaacatcaaagttgttgcaagacaaccatttcctaaagcaattagggatatgtgacttgtggatccaatcagccatcttggcagcaactagcagaagccaggatagagatggggttatacctatggaaatgctgctggctggtaccgaagggaacagagggataaaaatgaaggaagtctgttggatttcttgagattctataaaatgggtcagtagagctatctggctgtgaacatgtgttcttcaagaagagggaagaatgaccctgaagatgattgagaaggcaaaggggctactattgctaccacaggaccagagggctcaggcctgaggagtcaaggtaggctacttcttagggctgagggaggtgggctaccacactggtgggctcagaagacagggctgccacccctgttaggtgggaagatggagaatgaagctgaagaagattattcttgagccttaaaatctaatgggatttgcctttatacgtttcagacctgcttaggatccatcaccccttctttctgatttttttggaataggaatgtttatcctatgcctgtctcaccagtggtgtattttggaagcaaataacttgtctagtttcacaggttcatgctggagaagaattttgcctcagggtgaaaccttgagtatgcctgtacctgatctaaatgatatttagatgagatttggggcttagagttgatactgaaatgggtcaagactttggggctgttgggatggagtggatgtgttttgtgtctgagaaggacatgaattttgaggggccagatggcagaattttagaggttgaattgtatgctctccaaatgtatataagttaaagtcctaactcctagtacctagaatgtgaccatatttggagatggggcctttaaaaaggtaa

SEQ ID NO: 5959 - DNA, 2025 bp, Homo sapiens
ttaaatttggtcatagtagcatgaaatcttttagctgaatataaaacattttgacacctttaaaggataaacgctcataccttcaggactgtcaattcattttattagttatgtggtattagatgcatctcccttggtgcatactcttaattgttaatttaaagttccttgtagttttaattttaaaggacttatttggaatgttattacatttctctcattttgtaatcaccaacagaattttgccattgccagataatttaactagtgcaggaatttgactttgttatatactcatgaggggcaaattctttactgatcatttgatggttagctttgccagaagattaggagtattactatttcagtttcccaagatgataagtctttgaaagtggataagagaattgactcagtaaaggttacagccacaaagacagcaaaattgtaaaatcattctcattgctgataaaattgagtctttaaatgcatagttgcatacatgcatgaatgcgtgcacacacacacacacacacacacacacacacacacacacacactttgggaatgtaatctgtaaaatgtgttgccagtctcagaggaaactgtaaaataagtggagttttcgttgtcctggctttcttttctgcttctttttattgatttttaaattagcctaccccaatatcttccagggaatttttaaaaagttatctttctctctttcttgaggttcctcatatactctcactcacacgcacattttcacgagagcgaagtctacctttaactgaaatgaatgactgctgaatggtcaggaactccaagtccacatggaattcttgctcttcggtcccagactctcccttctgtgtcccccttaggcaggcaagatgatgatgaatgaagtcctggcagcttcctgtgtcccaggccttgtagaaataaatgagacagacgtgcttcaaagttctaatgtgcatcacatcggatcttgtttaaggaagcgttaaaaggaacccgccgttacctattgagaaggctctgtactctcaggcattgtttctgattgaatccagaggttgcaagcatgccttcctgtattacctgttggagcaggtttaattttataaattttaaacacaaactctatgagtttctagttcataattgttctttttggggatccactcagatgaacagtattgcatctgtaagagatacccacttcccaggaccagatttgattggaatatcagtggcaacagactccatctgtagctcatccagtaccagtgatggaaaggacagatggcaaggaaaccctttcggggggaaaaagaaagtcatattgtgttggacctacagattactagaaacatagctttagtaaaccaaggctttttttcttgaacacaatctgtgtagactgtgtagttcttgattggtggctttaatccattatcattaggtatctccttgaacgttctcaaacactgaaagtcttaagctttcattaaaaaaaaaagagtaaatgcagctttcagaaaatccaggattctgtacagtcttcgagtgtttcacttcagcctccctgtcctgttattaccaacagcaggtacccgggtggtagacaagaagcctcatgggatagataaggaaatgaagataaacaaacatatcacactgtatcgtaaacatactttataagtacatttcttattagcttcttatccaggtagagattataaaaatttgctgcaagtatccagaccagaatttatgttttggaaattatcagtgttcacaatacctgcagggaagaaaaaaatacaaaaactcaaatatgaatactctttacacccaaaagaatatttttatcattcttttatttgtttttggctctgtcaaaaattaaagtgcttggaatgctgtagtctgtggtctcttgaaatttaatcaatgagaacttagcattttcacagtatgctgtcactttggacattcataataaaaattgaaact

SEQ ID NO: 5960 - DNA, 266 bp, Homo sapiens
tcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagt

SEQ ID NO: 5961 - DNA, 426 bp, Homo sapiens
ccagcaccatagatgcccaagaaattgaaactgtctgaactatcttacctgcttttatcttaattttaattgccctcccatccctatgtattctgtatttaacagatgaagttaataatccttctaataccatcaaaacaattggccatcaatgatattgaagctatgaatgtacagactataaagaactaggctttgattcttatataatcccaatagcagacttaaaatcaggagaacttccactcctcaaagttgataaccaaacaatcctcccaatagaaattcctatccaaatattaatttcatctgaagatgtcctgcactcatgaactctcccttcactgggcctcaaaacagacgcaatctgtggacgcctaaatcaatccaccttaactgctacacgaccaggcctttaccacagat

SEQ ID NO: 5962 - DNA, 5965 bp, Homo sapiens
ctgaaattgcagaaattatctcatctataagtaaccccactggaattgcttgactgttctgtttcacagtggagaaattcatctttcatcagcacacacgagaagagacaacaggaagacaaaacaaattgagtagataataaagttaccttataggaataggtaatatagacaggtaaggtcagaaatttctgtggaatggaatatgaaaagatgtttatgagcagattctatttctttaggcagttttatcattcagagaagtaatctatgcatttaatctaatgccagcttttatttttctttggtgattaccacacaaaaataagaagttggcaccaaattaaatgcatggattacttctctgataaaagtactcgatataagggaaatttgaaggaaatagaatgcatacatacacacacatacacttagtatatgtgtgtgtgtgtgtgtgtatatatatatatctgtgtgtatatacacaccacacacacacacacacacacgtattggaggaataagaaatatttaataaaatctacacaatttcaaaaatatgaccaaatactggtggttcctcatttaccagtagaactctctctacaaatggaaagtgagaagtctatgaagttaccttagtttttccaattaagactgttcattgattgtatttcttctgtctctataagtaccatattcccaattagtatttcatcagttataagacccatcattattttgtgtgtaactgaaaatgaaaaaaagatttaaaatatgacttagtagttagaatttttatcttatacgcctttaagtaaatacaagagaactgtttcagcatagatttttaaaaatcatgtgtgtaaaagagaatgaaatattaattatgatatttacaaagctctgtacattcagaattgaactctttctgcatctcttttttgaatcagagttgtcataaaccacaatttttcacggtaacaccctctctgccatcaggataaataacatttcttaaaggaatattctactgcagtctctgagatttttttccctgtcttagacatccattctacaactctgatgctggcacattttttatcttggcaaaaggacttaatagaaaaattttagataacaatcaggattcatactcttctcaatagtccttaaatggtttattgaccaaaaagtaaagaagtaacagtccagtcatatcatggaaagaacaaccaaattcatgcatgcacaggcaaagacaaccatatcactatgaccacctggctgacagtaactgcaggacatcaattattgtaagacacttcctgtaatatgtttaattcctctgacataaggatttatgtgaattaggaagtggcccaagggtgaaaagtaatagggaaatagagaaatagaaccgatccaaaggaaagggggaaaaaaacccacaaaaagtgtgatgtcaagcaaagcctattctggagatgactttggttcactcccacgggagagccctagagacaaaaaggttctacagtaggttcaagtcagaggccagagaacccagagtatttatacctctgcaccatcagttattgaatgggggtgggggtgggggtgggtgtaaatttccaggtgcttccagcctgcaatgcagtcaaagcatgttcctgtagcctgaggacagccgtccaacaaagaggtgcaggtgctgaatgttgagagtgaaagcacagggagctgtcatgcatgagagtggtagagggatctgaaagtgctagcagtgcctattatacatccaaatactaaagacgcttagatgtgaaaaatgtgtgtcttagaatcgataaaatatggtatagagaatcaagtctccttgttcctggtttatctcatagcatacttaaaattcagctaaagatgaaatgccttaacaagtgaaatgggctttctgaaaaattatttcaatcaaaattgtgttaaaagctatttctaaaaaccctaacatgaaatacttagaagagatcaagtggtttgtccctggacattcaagcaattgaatgtctaaacaatccaagacagataattttgtagtatttactgtgtgaagtgaacctttaaggctgtggacaatgcaaactccctcatgtaccttgctccttgccaatttcaaacaaaccttctcacctatgatataaggcttccttagaattattgattaattatttaagatacaataaaaccaaagtatttttaaaacacagtaattatgttagtgcaggtacatgacatagatatcctcaaatattcttaggacatctataaatcaccacaaacattctggaaagcagtcttggaacatctatcaaaggccttaaaaatttcttcttctgtgaatttatcctcacaaatgaccccaagtttagaccaaaataaaaaaatgcttaaaaggcttattaaagcatgatttaaaatagaaatgattgcctaaattcctgaaaacaggggaatgtctaaataaaatatggtatctaacatgatagaaaatgtttactaatgtttaatgataccaagaaagtatcacaataataacatcaagtggtaataacaggaaacagatctgtatacaatataaaaccaacagtattgtatatataaacaccatagaagatctgaaaaaaaattagatgacattatttgtgatatctattttatttattatatttttctgcatactactctacagtgagcctgtcctttataagaaaaaatgctaatgatttattgtgtatgaaaaaagtgtatctgatttgattatatatttttatttccacttatattttctaggattattttgctttagaattctatgtataatcctgtgaaaatttgtagtgttgtagggactggaaagatcagagattatgttatggccatgaatgaggcctgacctgcattgtcaataactaaattgattattgtggaaacaacaaaaaaattcattttttgaaatgaaaatctttattgaaataactattttaccattgtgtggtcagattcactgcatttgatgctttttcaggatttgtttttcctgctagaaatgctagagttgtcacagatgtgatatttatgttttcattgtctggggagggccaagtttcatgacagagaaagactggggccaattctgtgattatggatgtcaacttatctcagagcagtatcattggttgagcagtcctgcaggacatctaagtttaccgtctttatcttgccattgtcaaagatcctggacctatttttttctgccttgaaaacttttgtgcagtaaaaccagcaatggattttagcagagttgatgcatcattaggattttcacattaactctttggacttagagccatgtctaaagtgtccttcttttggatatagtgcctggtgcagaactctaccacaaaacatcaggtgtgcctctgaatagtctttgcaagaagcacaaaatcctagaattgaggtgaatttgtaagttcctctagtccaaccacctttcaaatgaaagaatccttccaaagcacccctggccaatagctcatcaagattttgcttagatattcttattgagggggaacttactaactcctttaattcttattttgcttaaggctgagtttttaaaacatctaacatcagccaagattattgatttatctataaggaataatctgtgaattaaccttctgtagcttttccttgctgaccagggaatacctccccattgaagcctaggccagattccagtccgttttgaccataccccatcatggtattttagagtacacctgaataagatacatggtgccatgtacatggaaactgactgctctcatgttacgggttgaactgtgtccccccaaaatttgtatgttgaagtcctaaaattggcactgttgccataagccagggaactacctaggagatgctaggagagaggcctagaatggaaccctccctcccccgcccctggggccttcagagggagcggtgcccagctgacaccttgaccttggacttctagcctccaaactgtgagacaatacatttctgttgcttaagccactcagttagtgtgctttattttggcagtcttagcaaactaatacatcccccaatccagaactgtcctcctttggataataaaaacagcaataattatagtgtcattaccctgagtgactggtcccactgttggtcattctttgtagatgtgagttattgccctattgagatcagaagtcctctcacttagaggcatatctaagacttttttcttgtggagggagctcactcaactgtaggtaaggtttgactcatctgggttagtagtaagaacaaacttccaagtggcaccatcttaaaggtgcaagcccatgtgggcgatgaccaggtctggtatattaagaggctcttggtagcacattagaaacacctggagagattttaaaatttacaaagcctagccaaaccccagacccattaaccctgactctctgagaataggaccctggcacctgtgttttaaggattctaggtgatttcaatgtgtagccaaggttcactgccatagcctgtcctggaatgcaggtaactaaaacttcagcagattatgaaaaacaaaagttactttcttggatgcatatattcttatagcctcaaaactgaaactgcaaactgaacaatgctgcagtcagatacacacacatatttcaactgcataacttcctttaataatacttttatttttccaaatttgaagactgtccctaagtcatttcttctaaaagttagtaataatcccaccaactcacatttacatagaagttacagtttaaagtttgcatctcgtaataacttggtgagatagggcaagcattatttctaatttgcatatgagaaaaaactaaggctcggatgagttatgtgacttccctgagtcatgttagagtaactaactcctgatttgtaaactgaaggtcccaaatcctgggaactccctcagctctgggcaagccaggacaggtaggtcaccctgcacctacacaaggactgagctgagttctagttacctgctgtgaaggactgtagaggttatctaagccagctcctccttttactggaaaaggaaaagactgagataagtttccaaaacccctgctggagcaccttctacttctagaaagatgttgaggggcttccagggcacaaaggaaagagaagtaactgtgtctccttccccaaccatgtatgtgatacattcattctctaggattggaaattcccagaaagctgtgtcagcaatgagatttgtttcattgttttgccttgttttgtcattgagttgttatagttaaagtttattattttttaatgcagaaaaaagtgacttttgggggagtgcagagttctatgaatttttaacacatgtctagttatttgaccacaaccgtaatcaagatacagaacagttttatcatttcaagtgctctcctgctatgcttttataacacacccttccccaccccaactcctggcaattactgctctattctccgtaactgtagttttgccttttcgagaatatcatataaataatcatgtattatgtaacattctgagacaggcttctttcacccagcataatgcctttgagattcatccagatcgttgtgtgtatcagtagtttgtttttattactgggttatagttcattgtatggatataccacagtttctttagccattcacccactgaaagtcatttgggttgtttctaggctttggtgattatgaataaagctgctatcaacatccacgtattggtttttgtgtgaacataagtattcatttctctagatgaaatacccacaagtaggatttcttgattttgtgatatatatgttttc

SEQ ID NO: 5963 - DNA, 432 bp, Homo sapiens
attctcctgccctcctgcctcagcctcccgagtagttgggattatgggtgcatgccaccacgtgtggctaattgtttgtattttttggtagaaattcggtttgctgcacccactttacagagcaagagactgaggtccagagaggtccccacacttctttctttccccacttgaccacattcttggaatgaccgctcaggatccaatgagcattagttctgaatgttccagcagcattgaccctgtctcagttctgtctcccagtgacagagcgagaggtcactgaggacatcaagaagacctggccagcacacgacagctgctctcatcagaccatgcacacctacaccccaacacctgtgcacagacacccctacacctgtgcagacgcacccctacacccgtgcacagagacacctgtgcagacacaac

SEQ ID NO: 5964 - DNA, 3656 bp, Homo sapiens
caagatcgtgccactgcactccagcctgggtgacagggcgagactctgtctcaaaaaaagaaatataagatcaggtttcaaagagtttctcatgtagaaaacagtaggaagcaaactaaaataaatgctatctgtgtaagttgagagaacaaatgttatgagatgaactccaaattcctgtaaaaggggagtcaaaattttttaaaaattatttcattattgttatttttagacacgggtctctgtcgcccaggctgtagtgagtgcagtggtgcagtcatagctcactgcagccttgaacttctgggctcaagcaatcctcccacctcaaaaaacttaaaaatacttgtttcctattggttcatatttgaagacttcggtaggctacagatgagttcgtaatactttccatttgccatagcttagtaccagtagtcttaatgttttattcattcaggagtttttatggatcgtccattgtggagtacatactattctaagaagatgttaatatcagataaaagtaaaactaataatcttagacaagtcagcattaatttaatgaatgacttatctaggttttgaacctggaatactaccttagttagggtgtttaagaatttgggtttcttggctaggatcattcagaagtaaggaagaatacattagaagaggaaagggcattagaaggtaaattttagtagttgaaaaacatgaccactggacatagaaagattgttacttgacagaaaccaagtgtcttcaacagtgtcatcttctagagaccatcaccttggaattagtttggttatacagtatttttccctataatcttatcttgatataattttatccatacctattcacaaccccttacctgcaattccaaaatccaaaaatctgcaaaaacaaatttttcataattcatttggtgacatagcctgatctgaaatgatgtgaggctatttttagtgtttatccaactcaactatgaatatttcactacagaaacattaatgtctgattacttttacgcccgagactctacaggtattacgtgatatgtttaccacattacttttttaaagtccaaaattttctaaaccgaagagcaaattggtcctaagattctgaaaatggcatttaaacttaaataatgagtgagactaatctcatgcagaaaaatataattaatactgacaatgaatgtggatattcacgtaaattcagtatctcaaaaactcataaacaaatgctatattttcttttggcttttttttctttttgaaacggagtcttgctctgttgcccaggctggagtgcagtggtgcgatctcggctcattgcaagctccgcctcccgggttcacgctattctcctgcctcagcctcccaagtagctgggactacaggtgcccaccaccacgcccgactaatttttttgtatttttagtagagacggggtttcaccgtgttagctaggatggtctccatctcctgacctcgtgatccgcccgtcttggcctcccaaagtgctgggattacaggcattagccaccgcgcccggccttggctttttaaattattgtgtatttctatattatgctggtagtcaaatttgcacaaaacatttttcgaatattcttttaaaagaacttccttttcataagtgaaaagaaaaaaatcagtgtaagttaaagggcttatatattcctttagttccctgaatgtcaaagtaagcaggtttcataatacataatgtgcaattatcccattaaatgaaaggcagcttacctcttctttgcctaaattatattcatccaaaggctgaagaacaaccatcctccagctgttgaagataaaaaccaattttaaacagcttttatttatttaaatgtggcaattttatactcagcacagctaaatgtattagtgtttccttggcacttccatggttcaaattgttgtattttaatacttaattttttaaaagaaaaacatttgtattatgagaaaaggacaaaagagaaaatgagactttatttttggccttatggtgaatagtctgttctgtatagctgcattttatacataataattatgtactgactgaagtcagtggtacgctgataaactggcctggccaaaaagtaacagagaaggaaaaaaaccctggtttgtatgtttgccaatttctttggtgtgaaaatacctaccatagccccttttgagccatcagtagtttaataactggctcacagaagtcttctatatttaactatctgctcagccagctagctccagcctaccattgcaagttgaaatatatttttgctatagaacgtcatagccacaaatgttattacttatgcaacaagtatccacagattgagttctcatataactcttctagaatattatgctcttaatacctcaaagtaattatgaagtagtaaaagaaatgaaattagaatagagatgtatagcaattgactgaaattgtcacccacctgtctctgtttgcagccttttctgtctctacttcctggtgtcatttatattcttaagaagctgcattcatgatttctaaaaagtttggctaacgttactgccagtagggagcagatctgtgtatggcattcagggacctccacaaatctggacctaactttgtctctagccttccattatcaatctggacctaactttgtttttagccttccattatcaacctgcacaaaacagtatctggctaagccttacacacttgtcctgtgcctttgttgtcgtatccctatgtaaataccttctccaccttcccattccttcatggatgacttcccagaccttcccactcatcttttgaatgtgtttattgctgacttggcaatgcatcaaaatcttttttttttttttttttttttggtcacaggtattactgtcttacagtgtgaataccccatgaaaacgtagaactctttgcaacttatgtcacacctgtatcttcaagggcaaggattatttgttgctatagtttttatgtcactaaagtaccttttagtgtcatatacatagtagataacactggataataataataaaaaagactaagaatgctaaagtagtctaggaattcctaaatcttaataaaaactgagaaataaagttgtgatactatataacacttaaggcacgagtaatttttttttcaccgtttcccctccatggctatgaaggaactgggagaaggatgctcctttcattaattaaaattcttcactttgaaaatttaagtttattagggaaggaaggaagaaaaatatgaagatgtaagtatacataccttggagtaagtatttccttatattggagtttctctaatttagctggggctactaatgacatgggaatcacaatgttatctatgtcataagagctctcacttctcaatctccgtcgtgcagtattctgcaaaacaggattacagtagatttacagtactgtctagttacttgtaatgataccctcctttcatcagttatgtaaatatggcagtacacgttacataatttttgtaaatacattgttataaagtctgactaaaaaatgttaagaaaaccaaaaaataaaacatttttctatcttttgtaaatcaga

SEQ ID NO: 5965 - DNA, 1053 bp, Homo sapiens
gtaagaatatagaaaacttgaacattatcaaccaacttgaacgaactgacatgtataggacactccaccaatagcactttccaagcactcaggaaacattcaccaagataggtcgtatgttgggccataaaacaagtttcagtaatttcaaaagatttaaactatagaaagcatgcactgataaaaatagaattaaactaaaaattatagaaacctatgtgggaaaaccccaaatatttggaaactaaacacgtttcaaaacatggtatgatttagcctttaaaatgatctctcatactgctaagtggaaaataaatgagaaagacaagggcaaatgcagggaaaccctttaagaggcatttacagttgagtgtcatggactagagtggtagtggtggtggcaatgagaaggagtcaactgtgaaaggcaagttaagatttgctcataaactgaatgttgggatgaaaaagtggatgacaccaagattttcagcttgaatgaaactattgaaggctaggagttgatatttattaagatgggtgcgctagtaaaaggatttgaggggaaagattaggggttttgaacttgtaaaaattgagatgctgtagacacacagacacatccaagaagaaaagtcaaatagatagttgaaatccagtgttcccagggtatgtgggctaaatatattttgggcttctatcagcatatagatactagactaactgagatcaggagtcactgcagatagagcaggggtccagaattgaacattgggacattccaaatttagaggttggaagaatgaggaaggaccagtggacatgaagagcagcaaggcagaagtgagatactgaaagatgggaagttcataaggaagaaagtgagcaattcatcaaattctaacatgggattgaaaattgatcacaggaagtggttgcatgaggctggagtaaagggagttgcggacaaggcagcatggtgaccagcagagtgaggaaaggagatgaaatagagaaataaagtaagtatacttaatgggcaccctggcccca

SEQ ID NO: 5966 - DNA, 2410 bp, Homo sapiens
agatggagaggacgctctgccatttagaggtcctactgagtgggcacaccttttcccctcgagaaaaccttgtttctaccagagaaatgggcagaggcctctctctggaacttgaacctctctgtccctggaaacatcccaaagcaggcccagcctgccatgttcctttgttggggcacagagggaatggaatcttaccgataaggtgagaagagcttgagagaataccaaggacgggcccacccttctccctcctccctccaaacacctcaggctaaaaggggagggaaaaaaaaggcaccaacaaagagtttaagacagcaattcccagctttttcaaatatgaagcattttttaaccaatccgttttttaattcttaaattcttgacattacagaactaaactgaaatttattaacattccactcttacatttcttatcgacaaacagaaataaaattcatgagccaaaaaacccaaaacaaaactaaaaacagggaaaagcttataaaactaaatatggatcccagcattaacagctgaacagagaatgtgatttttaaattcttagcggatgataaagttgtgtagaaactgaacacttacaaattatttaaaacctggaatcactgaccagaaattacacagttggatcatgggagaacagcagaaaggggttattgagggaacctacactgttctagctgcaccccatgcccttctcagaggaaagcctggcattgattagatactgggccagactaatactggcagcagagccagtgatagtaacctgcctaccagaggagccttccactgggttggcaattttgatctgggccccggacatctggcggatctcattaatgttggcgccttggcgcccgattatgcagccaattaagttatttggaatggtgagttcatgggtggtttgagtagatgcatccaaacttgcccaatagcctttcacctctggagagctggagtcaattccggcgaatccggtcccgccgtgcatcatggcaaagtgagactgttgtcttgccacctggttcagcttggccagatcgagcggagaaatggtgtgttgtccttgaatcgagtaggcatctagaggtggtccctccaggtcatgggtggcatgggggtagcccgcagcgtcgctgcaccgatcttggccgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatatcttcctccagcttgtcgatgatcatagcgaaagccttaaagatggcattggtggggccggtcagagtgatgattctctccggacaattcccctccgagatgttgatccgcgcgccactctcctcgcggatcctcttaaccgactcccctttcttcccaatgatgcttcctacttcctttccgtgcataagaagccgaatgaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggaaaacaagctcagggctcccactgattgtacattatgagacggagtcttgctatgttgcccaggctggtcttgaactcctcacctcaagcgatcctcccgtcttggcctcccaagtgtcaggattacgggcatgtgctatcacacccaacctgatacattgcctttataaatttttttttctttattctaaaaaccagaaaaaacaaaactggatacatgtgcagaacatgcaggtgagacgtggtcttgtaacacagtggttaagaatgtgactttggagccagcctgctaggggctgaattctgactcagccatttactaactgtgtgaccttaggtggagtctcactctgtagcccaagctggagtggcgtgatctcgactcactgcaacctccgcctcctgggatcaagtgattctcgtgcctcagcctcctgagtagccgggactacag

SEQ ID NO: 5967 - DNA, 1124 bp, Homo sapiens
ggaaatcgaaaggatcagattcagagacggcaacttactcaaggtcacagcattttaaacccaagtgaaatctcctaggcccttcatgccacactcatccatccctacctacttgtgttgcaaccaagggccccactgtagtgcctaggggagcaggtctagggcacagtgccaggcctgattaatgtcttccttaccattttccagtgaggggctgtgattaggcctatttataggggcctggtcccttaatattctgcctggtgcatctcttgccaatcaaatcagtgctgtctgcagtgtgattgctgctttagtggcaccagggagaggagttaattaaacccaatataaataaccatttggcagttgatcaggcaatctcccctgctaccccatttctacccctttgtttccagcctcttttttcctctgcaaccaaggtttcttgtttatccaaggtggggagctgaactgagacaaggtatggaaagggtgcctggcaggtagcaagcaccttgtagggggtcagaaatgttgcaccttctctgaactcctccatctctgtcccctactcccctatctgtgcaggctgaagctatgtgcatagttgggatgagggctgtgttgtctcaacaccacgctgccctgtggtgggggcgtgccggtggtcgtgggtggctctgacgctccggctccgacccacaggcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctc

SEQ ID NO: 5968 - DNA, 680 bp, Homo sapiens
tcactcccagaatggcaaaaagatagatgaagatggagaaatgtgcacctaacactgcatctttatgagcaaaggattttctttggaaaaactgtgattatatgaaaatcataggacattttatttgtgactacagggcgtggtgaaaacctctgctaccatactggatacaaggtctttaacttctcagcaccagttttatggagcccccaccgctaagcaagtatgcaaaatgcagtgctgcttcgcattgggaaatccccaatctggtgccaagaggttcataaatacagtaatggaccctcttatgtcaaaagtgagtactgtttaacagcgtaagttggaacagccttcaggatgctttgcagctgcagttgttccactgcaagacatcacaaacttcatgatgatggttgtcacaccaggtcctggaaaggcaacctacttcagtctgcaaagtgaactaaaagggaatggttgttcatacatggccctgatgccactgacataagaaacgcaatgacaagagcgatgaagtaggaatttggtggcagatggtcaggtctgcaggaagtgtccacccagctttgtttggcccatattctgaaacaactagaataaacacttagtgtcataatttataagcatatcagtaccaataaatcagaatcatgcaaaca

SEQ ID NO: 5969 - DNA, 6412 bp, Homo sapiens
catgaaaagattattgggatttgtcaggcatagtatttctctgaggaataaatgaaatataaatttcactttggaaactaatgagttaaaaccatttacagtttctgttaacgagttaaataatgtatagaatcatagttcgtaatggtagcaagttcatgctctgctgaacttactgtttgattatggtcaaattttctatgttattattatagtagaattaagagtgtgtcctggtaaattacattaccttcacagtttgagcattctgattttaacattttgtagtttcaaaacaaactgtactcatataatcagagcattaacagcagcatcatgtcagtggtaccaataattgtgaatcttctgcaacaaaatttctttaatgatgagtttaatgggctatattcaaacctaatttttattcaattcataagtgcccactaaatatgtattttatttctgctgttctgttcctttgattatctgcttttcagtgagcatctgcatagctaaaatagatatagcatgtgttgtaaatgctgttgaatttttttaaggctcaaaggtgctagtatataaataacagcacattgccaaataagcattttttctttcattttctgaagtactttcatatttactcatgtaattatcagcatttatggtgagttggaataatttttcctctttattttcttaaatgaccctagaaaacaatgtaaagtagctctgaagaaggctttgttgttgaatctgtctcataattacttgtggatcctttgacacagaattatttatagtttataattcaccctcatctagagaatgatgatttctattacataagtaatgtaaattactaagagagaatatcctgagcagttcccaatggtgggtggctggctaaaaggaatccctggagattttagtgtggtaggaaagcattttcattcttgaggatttttctttgacttttctatgggctggctgatttcctcagtttgctttgttctgggttttaggggagaattcttgggaggttgtgaattttctttgcctacagtgagatggttagatgctgagtttttcgttctcactcactcccttgccagttccttagatgttatgatccagctatgacccagctttacactttcttcacccagaagtgacctcaccttttcatgacagaggaaacagaagccatggacttcttaatgctatatgtcacaaacctgtatgcatgtaagaatcttttatttcctcgtattccagtgttttaaacatcctgtcacccatcagggacttgtccttcatatgtatttctcctacacctttcctactctgtcatgcattttgcactattactgtatctctttcttgtattttcatcttgtcaccctgtatttatttattttccacccacttttaaacttagttacatctttcatggtaaacaggttctagggagatggtttgattatgtatcttaaattccctcccctcaatctctgtttccatctgccaactaccctgtcttgaatagagcagctgctgtgagcctggagcctttgggcaaataagagtgtatacagtcccttgattttaccagaagatgggaaagagagcttgctttgattttcttcctgtaatccagatgaaggtttagagacgggcagctgtgaagccttcagcaaaggtctgaacggaaagaaccttgctttcaaagatacatggatttagaggaaaagcggtgcagttcatatgtatggtactaggaagactagcttcagaaaaagacattggaagagattttcctcctgtcatctgtgatgaggagtggcaacttgctggttagtagataatcagcctacagaagagagctgccttctattgctcacaagtttgtttccgctcaagagtatcccacaatttgatttatgctaaatggggagtgagtggacaaagaagaatatctaaggaaacctaaagaaaaatagcatctagagagaacaggaacacagaagaaatggatggtgaaaaagaattgctggtggagatgaatgacaactttaattttgaaaaagcacctgagaaaattcagtcagtataaaataaactttctagcaattaaactacattaaaatgtggtagaaaaagagaggcatggccactattggggactaaatagtggccttggatatcatgtagaagtagttatctttggaaaagtaaaaatccaaagacacggagatttcaaaaatcaaaacacctagaagacgagtctaagatatttaatgtgagtaagtgaagaaccacaaggagaaaaagggaaacgatacaggagggcacaattactaaatactataggaaactttagttcgaaagggctctcactctaataggttccaagcaacatgggtggggttggagtgtggggacacacctaggcagataaatttcattcaaatatttattgttacttcctgcagtgacaagtactgttttagttgctgggaatacagggtgaacaaagcaatgttagttcctttattgggtggaaggaagtaaatgaataaatatgtctcaggtggtaataagtaatacaaaaaaaaaaattacaatgtgtgagatacaaatcaaaaacacttcttttttttttttttcccctcagtaacaggatggagtttctgtttatactgtgatggggaggattgtgtaaggatcagattttgcagtggtagcagctggaggaatcaatttagtttcggaatgttgagtttgagatgctattaaacatggaggagatattcaaattcttgaatttcagggtaaaaagaggaatttacaaaggaaaaagaaaatgacatctctagactttagaatgcaaccaagaatccctttttcaggtaagatcattcatcttgaggatatgtaatgatccaaatgatatatctgtatgtgtataacttcacataaggaaaataacttaaaaactttaaacagacagcaaattataacaaaggcctgtattctctgatagagtgactgggtatttataacataagtgttaagtaatcttcaagcagaaaagataatacatggaaaaatctcacactagtaactatcagtactaaagtaagctatcttagcaaaacttagaagtgacagctgagccagaggagtagagtgagtgaaagcattctaaatttcacaaccctagtgacaacaaatgtttgccttcatggaagaacaacatttgttcttgcaactaatcagaacttacatatttttaacaagtagctttctaaaagccactaaagccctttggaatattttttaaaacaacttcttttgaggttatggagatttttaaataggtcaggaaattatttctaagttgttatattgtgaagataaaaaagttttggtaggtaatatgtttgcagccacaaaagcacaaaatacaatgtttttaatattcaagatgtttcaaaatgttctttacgtggcacaaacttttttctaaaagtattcacagacttctggtcatctgattttataattttccattttgtgtggcatggtatgctggatgcgaggggataaggcttcactgtcaggtcttattctcccctcaccttatatacagatcagatgaagccatctgtacccatatattaactattaataaagttgaatttaaatacaaatatgtattttaacatcttcttctagcatcccactgaattatcttgcatgttccctgaggtgtgtgtgccttactttggagacctatagtactaagtaaaaatctttttatacagtatttgtcttgtgtgggtcatgagcattagcatccaatggtaggtgtgtgattaaaatgcagattccttggccccgtcccaaatttactaaataggcctttgtgggttatagccttgggatctacaaatttaacaagattgagaaaacctaaggcctaattatctttcagcctcatctaatccttccctcccaaagacgtgagcgccacatacattcttttgcagcctctcaacacaccattccttttcgcatctccatacctctgtaaatgtttctttccctgcctggaatgttatgaacagcataaggtatttgccattgttagtattatcccatatgagaaaaaaaaatagaccagaattaatgctcttaaagctaattgagcaaagatgtgtttacatcaatgttatccatgttctcattgatttatgaaaatcagatatttattttccacacatatactacaaaatcttgaaatctacttgtatggggatgatcacagattgtatctgaagaaatgaacacacacacaaatatatatggaagactaagtagtcatagcaatatctagtaaggagtaattaaaaattcactttttccctcttccatacttttataacatcagcacaccattaaattatagtaatcaccgcactgtaattcatcttcaaaatagtggggtgtaccagttatcaatttgttatctgtgagctctaaggtacaccttgctttgcagtgttgaaactcgatgcttgtacaggtttctcctttgtgagcaggttcagtgttaggctttttcattggagggacacagtaaggcaatagcaaggggaataggcttctctttctggttctggtgtgctgttatttgattggctgccagcagattggcctgcagaaggtcagtctcacctcaacaaccttcgtaagggtggcccacaccttcctttcaagtttctctgctgcctggtaaaatgtccctacagaacacctttggcctacccagaacctccagtgattcttctaccgggtgaggtgctctgattcgatcagctctggcctttccccttggtaaatttcttccatctacagcccaagttcctgtggcaactatgccctctccaaagagttctgagtctcagccctggaatagtgctggggagtgactcatgagttcttagtattctttctccctttgttatttccgtacccgttagaatcttctttataacttttagtaaaccatcttttattaacaattttctatatttaattttctctattcaaattactagtttgtgcagaatctagattttatagaaaaaaacaaacaaatgcctagtgatttgtttctatctccctcctgtgtggtttctatctccctcctgattggatcctgactgatacgttggggtatgctgctcatgagagatttctttcagagtggtgaataaactatgtcctagaaggcatattgtatcaggaagggtcacgtgttagagctgtggtttacattaatatatacagtgttaggaggagcataaagaggaaaacaccattgtggcaaagtaatcctgtggaaaccagagagagagagatttgataaagtcttggtgactgacctgagtacgaaaccagtggtggtggtagtgggaatctttagattaatgaatattgatttattcataagctacaaaattcaaagggcacccagtttctctttctagaggtaattactatgttcagattcctgggacctttccaggtatctgatgtataaatacctctctctctttccctctctttctaacacagatattagtattcctctgtgtcttactttatccccttaatagtatatcttggaaatcattgttttctttaaaaaaatgttttaattgaggtaagcattcattatacagtaaatgtcttgttccttttaactggctgcataccctgtcaacctatggctgtgccaacactggagagagtctgggttgagtatagtctttttgccattataaacagggttgcagtgaacattcatgtgtatacttctttgtacctatgtatgagtgtatcctggataaattcctaaaagtgacgccactggattggaggtcatttttttttaaactttttattttgaaataattatagattcataagaagttgcaaaaacaggacagagaggccccagttgcccttcacctagtttctcccaatgatagcatcttacataacatgatacagcatggtatatcatatcaaaaccagcacattggtacaatctacaaaccttattcagatttcaccagttttacatgcccttgtgtgcatgtgtgtctgtgtctttgtggttttatgtgcttttatcaggagtagatttgtataacctcaaacaagatgcagaactgttctgtcagcacaaagatcccttgtgctacctcatagtcacaccaaacctcctctcctccttttgtcatcacggcattcctaactgttgacaagcagctaatctgttctccatctctgtaactttgttattttgagaatataattgaaatcgtatagcatgtaa

SEQ ID NO: 5970 - DNA, 548 bp, Homo sapiens
atgacgaccgcgtccacctcgcaggtgcgccagaactaccaccagtactcagaggccgccatcaaccgccagatcaacctggagcactacgcctcctaagtttacctgtccctgtcttactactttgaccgcgatgatgtggctttgaagaactttgccaaatactttcttcaccaatctcatgaggagaggggacatgctgagaaactgatgaagctgcagaaccaatgaggtggccgaatcttccttcaggatatcaagaaaccagactgtgatgactgggagagcgggctgaatgcgatggagtgtgcattacatttggaaaaaaatgtgaatcagtcactactggaactgcacaaactggccactgacaaaaatgacccccatttgtgtgacttgagatacattacctgaatgagcaggtgaaagccatcaaagaattgggtgaccacgtgaccaacttgcgcaagatgggagcgcccgaatctggcgtgggagaatatctctttgacaagcacactctgggagacagtgataatgaaagctaa

SEQ ID NO: 5971 - DNA, 1998 bp, Homo sapiens
tacactcatccctgccattagcattcaggaccaatcttctatagcctatacgccacactggtctaggacagcacctaaataatactcatgctataaaaaattcatcaagttatatatttttaaaaacatccctaaaattatctttttcctttactgaaaagaatttcaggatcccctctctctcactgcctctcttcacacacacctaccttagttggtcacctattttgtaaacatatcttctttaaaaaaagaaagaaatggcagtacatgaaaaactgcttcgtaaacagaaactatattatttatatttgtagcatttttttccccttgaggttaatttcctttgcttcccataactggaagccaatgattcagtgccattatataagcttattttccctcttggaaatagtaaattataagaggtttgacccaaaaatatacatcaaaattaggcagtattcggtgtttagcctccatctgccttgtcttcttgtctttagttgtgcaagtagatgctgatgatttctggcagagctaaagtaagtaaatcatgtgaatttattttttttcctcataaaacagatggcatggtctagctctgggcttgtatgtttcatgaagtacatgggtctgagtgcgtatttattttgtgagccaaggtttatgccttcttctataattttctttcaccgaaaattacctggagagctagaaactccatttgtgtcagtgtaagaagctttagaatctatatccagaccaaggccatggaacaatgtagattcactcagtaaaaactcactagcggccttctttgtactagtctgtcacctttgcttggctttgggaagcttcaaactagggcagtttatgtttgggagtgaccagtcaaatagcaagacagacataggcaaggatgtaatttttaaaaatttaagtggggaatggtgaagcatgaatcaaaacagaaggtagtcttaccttcttggaactgtaaaataaatacatttgaaaaaggcaccctctcaaccttctgcgagtcagaatttttgctgccacccctcattttgaatctctattctgcattttttattcttttttttaggaaggaggaagaaaaatttctcctgaagaattcattggaaattaaaattaacttgcgtattttgtattctttggaatgtgatgaagactgatttgaaagggcagtgctggatttggtcaggcataggaaaggaagacatgcagtcgtcctgcctagctcatccccgccacgatggagaagtggggttgctttcgttgtactttttttcatttgtttcttgccaagcccagtggcttctgttataacatgtggcagcttctcccttggagactgattcagtccaagttaccataatatttaggaccagctacagagacgtttcttcccctaaacccatgccaaatctaaatcaaactatcttcttctccttagccgttcaaatagctccagctcttatataaaaatacgagaaatacacaggcctcttttcgttttattcctgttcaaacagataaacaaacaaggcacatcatgcctaggttgctttgagcttgatcacttcctcctaaagcagtcttacgctgtgttgattttaagaattgcaacttaggtgttctagaacatattctgagagcatagtcatagtctgtgatctcagaatatgtttgcttccttctagaacatctgagttctagaaattgcgtacaataaactgctgtcagtgctgctggaggaaggaagagtaactctgacatcactggccttcaacaggtgtggcgctgagcttctgggcctcagaagccctgacttctagaggctgggggccagcggggcagggaggtgatctcatcatggatggccacagatcatccacctgccaaacagttaaccctgaacaagtcatgtcaatttattttgcttttaaaaaagaaagtctgcaaaataga

SEQ ID NO: 5972 - DNA, 1632 bp, Homo sapiens
ccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacccctgtatgaccttcgtattgaccaaaagatttacggagaactatggaagacaggaatgtttgaacgcatgtctctgcagacagatgaagatgaacgcagtattgaaatgcatttgccttatacagctaaagccatggaaagccataaggatgagtttaccattattcctttactggttggagctctgagtcaaaagaacaggaattcggaacttttcagtaaatatctagcggatcctagtaatctctttgtggtttcttctgatttctgccattggggtcaaaggttccgtcacagttactatgatgaatcccagggggagatttgtagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccgggctcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttatggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaataaataaat

SEQ ID NO: 5973 - DNA, 1809 bp, Homo sapiens
gtctcagccgcttcctgtcagcgccaggagcggggattcccggggtcccgggcaggtacctggacagcgcaggtcctcgcaaggccgtttctcagggacgccggcctcgccactgacgtagcaccagggcccgcgcgggtcctcgtccgggtttcggcagtaactgtgattgccggcccctaagagaggagagaaggaaatgtgtgccggggctggcaccgggaacgcggccgccgcccgccagccccggggccgtcccccggaggacacttacccgacacgggggccgaggccagcccgctctgcgcgtccagccagttgaggcagcggaggcccggcgcgggggaggtctggtcctcccggtacaggtggccgttgtcccagaaacagcctgtgaggaaaagaagcccccggacacagaatagcgggcagcgaacggaagacgcccagcgtggcggacaggggagccgggaccacccgggctgaacctcagcctggttaggggaccccgggccctgctgggcctccctctcctctcgtggcaacacccccacgccccacgcaccccccccccccaactccacgcacacctcagggtgtgaagcccccagcctgtgcctgtcccccagtcaacgctcagagactgttaggttttatttatttttgaaacctggaaagcgctgcagaagtgcaaagcgttgttactcttgaacttgtgaccactttggaggaggagatggagaggaggaggcctggcttagggtccctttgaggagctgggagttttgggacggggggcgcccagacgtgacatttgtccctgtgttgtaatggccacgttacataaactccggtgtttcctccttcacggatacggccaccttctgcccgtttaaaaggcaaatactccctcccaggagaattctccaggagccttgactccgtcaggcaaaagattcaagacagcctcaaacggaggaaaccggcctcatcgctgactggatgagactccaagctcccactcccctctgcaggagaaccacagaaggaggctggggaaggaggaccacaccatgcaaagggcttagaaagaacaggacttggggagtaggggagatgaacccccaagctccatccactcatgagcaaggaaaggcagagagaaagtggcttcttgcctttgttcttaatggcaaagatggagctgcaagcccctgacaaggaaaggaggggtggaaaagctttcacgggacaacagaaaccggctaaacgcttcgtttcctgtcatcctggccctgtttgggaaatagggggctttaccccttctgtttcatgaagttgctgcggaaaggaaagattgtaatctcacctccagatccataggcttctgctaggagcatgttgctgacgaggaatgcttgtacccaggccaacagcatccttgcctccttcgtcttgcaggtgattgaacgaccagtgtttaaccgaggcccccttggcggcggctctgcctcccagtcccagccttgcagtcagacctgcccttgttatgctgttctggtaaacagcctctctttagaactgggagcttcccagctagcttgctgcagcgcgagctgtttttcagctgaaaggcgccccctgggtcctaagcctcctaggtcatgcaaaatctaactgagccaagaaaggaactcagccaagagatatgcaggttgtgcttagcagccgatcagtttgagacctgcgaggccgcatccccagggtttttcatctcttctgtttccatttgtaacacttcatcacccc

SEQ ID NO: 5974 - DNA, 872 bp, Homo sapiens
tgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtcca

SEQ ID NO: 5975 - DNA, 2467 bp, Homo sapiens
gttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatcttttttaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttggaaggaaggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaac

SEQ ID NO: 5976 - DNA, 1621 bp, Homo sapiens
aatctgtgtgttttagatttcactaaatttcgaaatattttggcaattatttcttcaataattgcctcccctttttttataattacagttacttattaggctgtatgaagttgtttgacaccccaaatctgtgtttcctcttttcccccccatcattttttttctctatttttaaattttggataatttcctgtgtctgatctgttagacgttttatatctccttgtccttacttaaagtgtataggttttcttcagctttcttgaacatagtagtctgtttgtactatttttctcttccttatggattgtatgttctcgcttctttatttgcctggagaattttcttggatgccagacaatgtaaattttactttttggggtgctgaatattttgtattctaatatatatattttattttttcatgaaatataatgatattatttgaaaacagtttgttgcttttagacttgcttttaatctttgtaagtaggatcagagcagcttttaatctaaggcaagacttactgtaattattggtaatttttataaaccaatgttgtctagtttggtaactgttaagcacatgaaatgagactaagaaactaaatttttagattgaatttttaattttaatgaattttacctttaaatatgtacctcattagaatagaattaaggtaccaggtttgaaaatgcagttctaaatcccatttgaccccactattaaggctctgtccttatgagtactctgttaggaattcactagatgtctaagagcacaaagcattttattccctgaaaccctggggttgcttgccctgctacttttcgatagtacctttcctggccttcagtggtttgctcacataggttcgtcagtacatgttgaagtcttgaagaccctgtatagatctctggagatccagggatctccagatctctagatgcaaatctgcatagatgcaaatattttcttcctggatttccggctcttacatcctcagtctagggtgacaactaggttgtgctgagctgtggcctaggaattcttttccagacagctcacacaatcctaggggtcacctcattggtttccacttacccaggcatcactgccctgccctgcctgatactcagtgtctgaaaagtattgttaatatatatttctagttaaggttatttcacgtgggagatgaacctgatccttataattccagaagtggaattctaaaacagagcagctttttgcatacgttcaagtacagagaaaaaaataaaacagaaatttgtattaaaaaataaaaaagtaaattaatattagaaaccagagcatttttaaaaggaagttgagaaatttttttttagtgtttgaatggcatttattctttatatttacttttgaaataagggtaataaatgaaaattggctaaacttctaattgcactaagtaaattattacctaatattctttgtgtgcttttcttacctgattatgctatgaattaattttgtgaatttcttattatttaaatgtttcactctgacctgtgtcagtatgtttgccatttttagttgcttggttgtttttgttagaaagtaaaatgtattgttgcacca

SEQ ID NO: 5977 - DNA, 4682 bp, Homo sapiens
acttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaagcggatcctgttacagtgcaaagaagaaatggcaaacggataacagctactgtgcctagaagatggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaacaacttttaaaagcctttccactgcacagtgaaagaaaaccacaaactccttgtttaataagtgggatcacgtgcttttaacacgaggaaaaggtcaatctgaagcaactgatatggaactgccagagtaggagttgaaaatcttcctaaactgctggaggatacacctctgatagcttgagacaaatatcctcttgatcattgtttcaccatatttgtctttgctcatggagaaccattttgatccgtggtttagcctcccaggtgattgaacaataccggtgatctgaggcagaccctctgtgacggataacaggaaagaatattgattgaacatctactcaagaactgcaaaacagagattacctgacctaaaggagtccattctcaattttctgtgcaaattggggaaggctgttgataatcggtggatgctatagtgcccatggaaagactctagtctgaagataccagtctctccctcccaagatcacctcccctgaccaaccttctgcactcctgacagatacaagggagcaagcaagttgcacccaacctaatagtaaattgcagggacatttccattctaaggaaggaatttttgtgtgtgttgcaactcagcttctgctctggcattttgctgtgcatttatattgccaatcatgttggagagtccatgtggtgatttctgaaaacgagatgtgagaaagaagaggataatttaagtctagacctacagattgtgctgataaagtgatgaagaactacaatcttcttagtcatttcattgtataagtgcaataaaggattttgtgtctttcctggcaaacaacttgtgaccacagtgatggctccagcagaatggaaaagaccctttacctcacatctcagaatgtgagaacagaggagaagcctggtttgagtgagtttttcctgaagcaaaagggaagagcttaatttcaaaaggaatatcttgaaagacgcatcaactcaccattagaaaacatgaaacgacagattacacccacattgaaagacctatcttaattcagacttcaaaatcttacaaacgtccaagtccctcctttgaaatgctactaagactgcagtaagaatacatagcatgcagtgactgagaggaagagagatactaacacttgaagtaatccagtctatcaataggagatggactgctttgatttaaagcgatttacaaaaggatttggatacctcatctctcctgtttcgccaaggtcttgactcatcgctgcagatgactaaatcccattgagctaaatctcctgaggttttcctggagttggaagaatccatctattttgctagggaagcaaagagatgaaattatgaagttatgaaaattataatttataaataaaattataaaattatgaagttatgaaattataaatggtgcccagatgaacaaccacactgagtacaaaggatggtgtctgagatcacggaggtgggcctgcttcatttcatttgacagtggcctcagagtaagcttcgttgaggttggtgttctgtgtgactgttgatgtctggtgggagaataacatggcctggctgtgggatccaggccggcttctgaatgcgaagggctgctgctttctctttcctcatccattctacgtcgctaaagcgctcactgagtgctggggtcgcacagtagaaatggtttctgtctttaagggatctacaatgagtgttaaaagcagatggaaaatagacaatgggcaattaattagtcaacaaatatgaaccaagtgccccatggggcaggttctgttgtggacacgggaaatatgaaggaaagcacagacagagaccctctgccctcacggagtcctcattctagcagaaagagacaagcaataaacaaagcaaagaagtatgttatccattgcgtttgagggtaattatggggaaaagaaaaagcagagttagaggaatgacacccgtaagagggaatggcaagggttgcaacattaaactgggtggcagagggggtatgctatgatgagtgtatacggaaccattatatggaggaaatacacaaccgctcaggcataattttttatccatttttttgataacttataaaccagggaaaaataagatatgcactgttttat

SEQ ID NO: 5978 - DNA, 1942 bp, Homo sapiens
agtccttccgggagctccggagctccggggcttccaccacatctgccggctcaggacgggtcgtgctcatcccttaactttttaactttttgttgtttctatttatattttattgtgctatgtcttgaaatgttgttgtagctattacttttgattggatattacttagtattcctactttaaataagagtagtttgcacaccacacagctatagtgttataatattctgttttgttttgtatcctattagcagtgaggatttttttttacctttaggtgatcatttattactcattaatgtccttttcttcctgattgaagtactccctttagcattcctttaggacaggtatggtattcataaaatacttcagcttttgtttgtctgaaaaagtcagtattctttttttttgaagaacattttcactgtatattctattctaaggtaaaagtttctttcctttagtactttaaatatttattgcttctctctcccggccagtagagtttccactgtaaagtctgctgccagacatgttggagctccccagtaggttatttgtttcttttctctttcttgcttaagaacttttatctttgacttttggaagactattgaatgcttcgaagtagtgttttttgggttaaatctgcttaatgttctataacatttttgtagttggatatggatgtctttctctaggtttggaaagttctctgttattatccctttgaataaatttttctacccctgcctctttctctacatcttctttaaaaccaataactcttagatctgtctttgtgaggctattttctagatcctcccctgcctctttctttacatcttctttaaaacaaataactcttagatctgtctttgtgaggctattttctagatcctgtcggcatgatttgttgtttttattctttttcttttgtctcttctatgtattttcaaagagcctgtcttcaagctcactatttcttctgcttgatccattctgctattacatggctctaatgcattcttcagcatgccaattgcatttttcagctcagaatgtctgcttaatttactgtaactatttcaatctctttgttgagtttagctgataaaatttggaatttccttactttgttatcttaaatttctttcagttttttttttttaaatacagctattttgaattctctgtctgaaacatcacatatctctttttctccaggatttgtccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaaggctttggtatcaggatgattctggcctcatagaacaagatggggaagagtccctcctcctctatttcttgaaatagtttcagtaggactggtactggctcttctttgtacatctgttaaaatttgttaatctatcaggtcctgggctttttgggggttggtaggctatttattacggattcaatttttggagctcataattggtctgctcagagactgaatttcttcctggttcagtcttgagagagtatatgtgtccaggaatttattaatctcttctagggtttctagtttgtgtgtatagaggtgctcgtagtagttactggttgttatttttttttctctggggtcagtggtaacattcccttcatcatttctaattttctttatttgaatcttctctcatcttctttattaatctagctagtgccctatcttagtaattttttcaaaaaaccttgattaagtgatcttttgaacagtttttcatgtctcaatttctttcaattcagctctgattttagttatttcttgtcttctataagctttgtggttg

SEQ ID NO: 5979 - DNA, 9059 bp, Homo sapiens
cggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagtaaaatttaccagctttttttcctaaagaggctagtcatatctcatcagtggttacaaagtatccttacaattgaacctacatttgttaatcctgttcagtgtgtatgaaaatcacttggtggccgggcatggtggctcacgcctgtaatcccagcactttgggaggccaaggcgggcagatcacaaggtcaggagttcgagaccagcctggctaatatagtgaaaccccatttctactaaaaatgcaaacattagtcaggcatggtggcaggtgcctgtagtcccagctacttgggaggctgaggcaggagactctcttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtccaggagttcaagaccagcctgggcaacatagtgagatgcggtctctacaaaaaatttttaaaagttagccaagcatggtggtgcttgcctgtggtcccagctacttgggaggctgaggtgggaggattgcttgagccatatgctctaatatattttaaaatacatattttaaatatattttgagtggtaaaatgtagcagataatgttacataaaagaagccatggtaatgacatgacattactggttttgagttgtttgtgtagtagttagctattaatactcaggtataatgatttgctatttaaactacacaaatgctcaaagtccagcgataccctgcacccaaattcagtggctagattaccttcttaggaaagcacaacacttcaatggagtgacactggcatgagtccactagagggtgtgtatacatggcctgagttcaaattgttcctgctgtgagtactgcttttcagcttcaagttattcttatcggccacagtactgtttattccacttagtaacagttctgtttacagagcactttaacataaattctgatttttaacatgaaagctgtctgatgttggtatttttattttaatctttagagatcaagaaatttttttagtgacagaatagggactttattgatccttaaatccgcccctcaccacaataaaggaaaaaagcaaaaacatccttgactcatgtattgaagggtcttttttgagaagggtcagtttttgaaaaattatccaaaactgaaacatctgtcatctgtatcacatctaaagattaacagtgactgatgaccaccagttacttcatatgaaagtgggaaaccgtatcagttatttgtccactaagttggtaggtgctttttgtacaaaagcccaggagaatatgatctgtaaattctagttgagtgatgaagatggggctttgaattaatctacagtcttggaattaattctgcagcattttaaccagggaatttttcagtagtcataaatctatattttaatactgagtaaatgtcctcatttacccccaccaattttgtaaagcagatattaaccaaacttcaatagttataagacaaaaatttaatgaaaattggacagtatgtataatccagggctaaatagttacattggactggagtagaaatttaaaatacaatagatgctggagtaaatgttacatattatcatcatctgattcatcttcttccttcagagattcctgttaagagaaaacaggtgtttaaaattgatttttaaaattgttatatcccacacctgtgggcaagttaagctacaacaacctgaattaagtggttaaattcctctacttgtaactgaatgaacagtttcagaataagatacccaagcaaagttaattaagcaaatgttgctctaacatgcaatgactgtatctttgatagaatatatacttaagaggcctggtgcagtgttcatgcctgtaatcccagcactttacgggggccaaagtaggcagatcacgtgagttcaagagtttgaaactagcctggtgaaaacccgtctctgtattattggtgaagccaaaaatacaaaagtagccaggtatggtggcatgttcctgtaatcccagctacttgggaggcggaggcaggaggatcgcttgaaccctggaggcagaggttgcagtgagcagagatggtgccactgccctccagcctgggtgacagagcaagactccgtctcaaaaaaaaaaaaaaaaaaaagaacaaatatttaaagtattaaaagtcctaaaaaactctttgcagtctaaacctcccaagttttttttttttggaaccaaggcaactttacccactagagataacctagaaaatttctatctttagttcaactgaactctcagtgttatttcatagaaaccaccccagtctatttatattattcaacacataattttggttagagaatttttttttttttaaattagggatgggggtcttgctgtgctgctcaggctggtctcaaactcctgggctaagtgattccctgactgtacctggccaagagaagtttttgtgctgtggcttaccttagcatatttctctgcttcttctcttatatcttttggaacaatttcatgtcttccattagttactgtaaattaagccacatgtgtaaatgaattttaaattgagtaccatattgtaacttgcagtataccataggatctacccaatccacatatctgactcacctaaggttgcaaagttgtactatgagtaatactcgaatatttttgtgtgctgcttctacatgagattatatgtgcctacatattaagttcttatggaaatgaaagtaaattatgctatttataaatcctgagcattaatttatagcatagtatcttaaaaccatgaaatggatgtttcaaaaaataacgtgttcacaacttaagtcaattattaagcagaactttcccttcattagacaacctagtaaatttgctttagctttcattatattagaaaggacactcagttgtaaattagctgtggtacagatcattcctaaggcaaataaatgtacaaaaataacttacattcaccaacccagctgagttctagttcaaaagctttatccttaacttcgtcatgtactatgtaaattctagaatagaaaagggaaaggtaagattttggtaacctccaaacattgaagtagttcacagacccaaagtcagtacaaattagaatgtccatccataataaaagtatctataaaattacacagacacattctacatagtatttaacattagagaagacaaattacacagggactgaaataaaatgaaacatctactctcccgacaaatgttgaatatacctaatcaacccaagttcagtttatttttgcacattgctttagagatataacttggctgggcacagtggctcacacctgtaatcccaacactttgggagaccaaggcggatggatcacttgaggtcagttcgagactagcctggccaacatggtgaaaccctgtctctactaagaaacaaaaatcagccaggtgtggtggtgggcgcctgtaatctcagctactcaggaggctaaggcaggagaattccttgaacccgggaggcaggggttgcagtgagccaagatcacactactgcactccatcctgggctacagtagagcgagactccatctcagaaaaaaaaaaagatacaactataaaagatacctcataaagaacacggattcactaggaagaggcgtcattaactgtgcccttttagaatattttgtccattaacttaaatatatttaaaaccaactaattggctggacatggtggctcgtgcctgtaatcctagcactttggggaggcagaggcgggtggatcatgaggtcaggagttcgagaccatcctggccaacatggtgaacccacgtctctactaaaaatacaaaaattagccaggtgaggtggccataggcctgtagtcccaactactcgggaaactgaggcaggagacttgcttgaacccaggaggtaggggctgcagtgagctgagatcacgacactgcactccagcctgggcaacagagtgagactctgtttcaaaaaaataaaaaaaaaaaaactaatttatgtgcttgcaattattagtggtctcttcaacctatagcttcttggcagtagtctttttaagctccttgtccattttataatggcatatatgccacataacctggccttcacattgtagtaccttacaaattacagcaaagaaggaggcactgtcatgcaacatattaaagtaacataaaaagtatcaagaggccaggtgcggtggttcacatctgtaatcccagcactttgggaggccaaggtgggtggatcacaaggtcaggagttcaagaccagcctggccaagatggtaaagcctgtctctactaaaaatacaaaaattagccaggtgtggtggtgggcgcctgtaatcccagctacttgagaggctgatgcaggagaattgcttgaacacgggaggcggaggttgcagtgagccaagatcgtgccactgccctccagtctggacgacagagtgagactccatctcaaaaaaaaaaaagtatcaaattaagtacagtagcagagtatagctttatctaatactatgcactgagttacataccttactttttggagggtcttctaaaaccttgctataatatgagaggatcttgattttctacaactaagtaaaagataacatgctgctccattttcttaaatgatgaagggatggctttcctaacatggaacacttaacagatgactaccattatacctaaatataaaagatggtaagaactgatttccagaaggacttcaaaggattggttcggtgaaggaaacagagtatatcatgataacatactatacaattcaaggaagatatctgacttcctttcttagcagctctgctgcatgttggttcctagtgttgccattattaactgacaatcatagaatggcttctgcttgcttcacaactgaaactaggagggcggaggggaggaggtggcaagaggggtaaaggcagtagcagtaatgatggaccggttaataagagactctgagtgtgatgtaaatagtatgtttattaaacaatagagcccattggaatttttttcttccacgtattgttagatgtaaaacctgatacactaccatacagacaggtgattgactagaccttgtttatgtagttctaatgtggaatacttagagttgttatgaattacgattatccataacttttgaatctaaaaagctggctacacaacgtattttgttggaatctttttgtaataccaaatgtctacactctttgatctagagaatcacaaaattttagaaacatcactacccaggttaattgacttttttattgtttactgtccaaatacctgttacatattaatagtattctactttatatacctgtaataaactattcagggtttcttaagctggttgttgaaatgttttgtaatactgctcttcttaccttgttataggaacttttataataaacctgaaaaagtgaaacatatctttcccaaataaatagcagattatataaatgagccagcttcatggatcatgtattgaaataattagttgtaacctataaagtttgtaagcattcttacaatagaggcaatcttaagattactattattaggacttaagagatttgagaagttgggagctaacaaattaagaccctaatggtatatgtccttaacctgtaacaggagtttattttgtcaagctatttttcccatcctattcattactactaaaaaatattgcttaaaaacattttcttccttcgtgaggcttcttagaatgttaaatttaccttctaaaaattatacactaagttattttacaggaaaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttgatttttctctgggatttattgtttttcccattccttgctaggatttaactacagaaagacagatagtaactgctctaaatattctaatttcctttatttttttgagataaggtgtcgctctgttgccctggctggagtgcagtggcgtgatcatagctcactgtagcc

SEQ ID NO: 5980 - DNA, 1562 bp, Homo sapiens
aaaagaacttaaatgacaaactcatagttacttgagtttgtaattcatagttaactttcacagttctataatcaatctggaattcagagtgaggtagagatcaagcagtatttctcccatatggatattcagttgatactgcagtattcattgaaaatacttctttcctgcatcgtaattcaggtgaacaatccattggtgttatttctgtgtccttgccaatatcacacttttaattactgtaactttataataagattttatatctgtagtagaagtccaactttgtaatccctcccaattggcttggctattcttggccttttgcatttccatataattttttatttttgttttgaaacgaagtttcgctcttgttgcccaggctggagtgcagtggcgcgatctcggctcactgcaacctccgcctcccaggttcaagtgatcctcctgcctcagactcccgagtagctgggattacaggtgcccaccaccatgcccagctaatttttgtatttttagtagagacagggtttcaccatgttggccagcctggtcttgaactcctgacctcaggtgatccacacccaccttggcctcccaaagtgctgggattacaggcatgagccaccgcgcctggttgcattcccatataaatttaaaaacaatctactgaaagatgtatacgacctccaccaagaaaattgtaagacatttggagaagtttaaaaagacatgaataaacggaaatggtttttttaaataaacaaatgatttttaaagttgatcattaggttaataaatagtcatataatgacaatccgatgagattatgttgcccagggtggtctctaactcctagcctcaagcagttttactctctcattacaggtgtaggccaccgtgcctggcctgacacttggaaatcttaatcacaattattctttgtttttataatgtttactgttcaaatcaatttctggttggatagtatgtatatataaagccatgctcaatggcctagatatatttactgccaaatcttttatgcttttagtgttttttttctggacaagatctatgcttattgcaataaattaaatgcaaagaatattctagtagaaagtcagtctgcacttcctaaaccccaccccaccccaccaattccttcataactgttattaacagttagctgtgttttctaatggattatctccaaagtatatgtaactcagatttttgtgaggtaggaaaagaataacattaattccacttcacatattgaaagtctaacatacaaagagattaaatatctcctttcttttgccaaatgttaatgaattgtcttatgagaattaagatatgatactttctcccaagctatactgtttcccataaagtatttgagatgttggagattcaagggaaaaaatataaatgcttagaaataaagtgtataatgcaaagattgtgaataaagtgacacttgtatgttaatcctataaattggtttcttgtaccatgtaggatggtttggctattaaattgaattaagtggttca

SEQ ID NO: 5981 - DNA, 2888 bp, Homo sapiens
gatctgaatactgaagggttggtaggggaccagagaatagaggaagcattgtaggttctagagtggagaagggaccatccaaaatggagtttgaaagagaattctggcctttgtgtttagagtctggaattgtcaagagtctgaaagcacagaataagactgcagctagagcaatttaggcgccatagtttgtcaaaacagagacgggatctcactgtgttgcccaggctggtctcgaactgctggactcaagtcatcctcccatcttggcctcccaaagtgctggaattacagtggacaaccttcaatgcactggtactttgtaccctgacctctactgtgatgaacactcaacttgggcaaggaagtgaaattctccaaagcaaggaggagggtgctctgaatagatggaccctgattctacttacaaaactgtgggaagaaaccggagcttcctccctctctgagacaacggtgccactgagactgcgtgagatgcgacgtaaattctctgcactgtactgctcatcctccccacactccctgctgaggcctcggcaaggtgtagccttcaaacacacagacacatacaggcagacacataataccagacttatggttttcccacagacagtatcctcagggtatgggaaagagtaggggaagactcagtagtaatagacacctgaattagatgtattggtaagatagtggccatgtaacaatctcctctaattcaaaagaagcccaatcatagaccttattttcttctgatagccccatatcaccatgcctctgccttatcatcatccctgtcacatctctccataattccttccccaacacaccaccccaggcccagcaccttagcacctgaggctgctacctgagaagtacgcactgttctggcttcatggagaccatgctccatttctgctgttgaagtctttgagagaccaggatcatgggctgagtgcaacctcctccccatgccatctgcagagcctgaagaggaaaacacaaatacaagttgaggccatctcttcccctagggcctaacctctaagcctagcagcacaaactcaggagctgttgtttcatttaataataaatatgcatccttgaattcaacggaggaacatgctcctggaatttagaagcaagaggggctgggcgcggtggctcacacctgtaatcccagcactttgggaggccaacacgggcagatcacgaggtcaggagatcgagaccaccctggctaacatggtaaaaccctgtctctactaaaaatacaaaaaattagccgggcgtggtggcaggcacctgtaatcccagctactcgggaggctgaggcaggagaatggcgtgaacccgggaggcgtagcttgcagtgagcggagatcacgccactgcactccagcccgggtgacagagcgagactccgtctcaaaaaaaaaaagaaacaagaattttagaatatagatagtttactgagtgtccccatcttgcttcatttcatttttgtaaacataatcagcttctgtcagacttaggctcaagacttatagacagaggaaagtatctaacacagtgagttttgttttctaacacagtgattttctaaagtatctgtggtgacaaaggaaattatctccagtctagttcagaatagaaatgatcataataatcatctatcaaacctcctcattttatataacaggaaaatgagttccagggtctgagagtttagtagtttaaccaggattaaaattaaatcctcttgattttcagtacagtactcttaccatctcacctggtgacctcttttactctgagagcaggagctcctcaggaatgttttacatatgtaatgctcttttccccttagcttctctcaaatcatttaaatttctaaacaaccactaaatgcttacctcttttcaaaatctttctagattgttcagttgctctaaactggattggtgactcccaaggggctatccccaatccaactaattaagttttccattccaaaactgtatatgcccctgacctacatttgatacatatgtccatggccaattcatgtcttgatttgatgatttgattctaatatatatatatatatctggctgaagctgatattattcatgtaagtattgtaagaccagttattttcagtattcctgggtacttaaatgcagtgctttcaataccacctcagattcatctgggaacttttaaaaatatagcttcctggatgttaccacagagctgaatcagaaggtttgtggttggtgcctgggaattttcatttttgaaaggttcccaaaaagtctaagaaaatatccttgaacattattgggggaaatgggaaatgttacagtcttcctaaaaaacaacctggtaatctccaataaaataaaaaatatatttatcctgttgcccaacgattctaatcctgagaagaagaagaaaaaaataccagttcataacaacatatatatgagaatattttctactgacataatttatagtagccaagaactagaaataaagtaatgcccacctatagaagaataaatacattatggtttaataccagatattgtccagccacttaaaaagattgaactgagttaaactagatgatttgaagaaattttaatgaaacattgttgcattaaaaggaaaaaaatctgtaaaatgatagacaagcatttgtttatgtatatgtaggtctacataggattgtataaacagaaaatacagtgtatgcacactagataattacctggggaagtagggactggctgtgagagaagagacaggaaaattgtctataataaaaacagcatgtgtgttatgttcttatttctataaaatta

SEQ ID NO: 5982 - DNA, 840 bp, Homo sapiens
cgcccagctaatttttgtgtttttaggggagacgggtttcaccattttggccagggtggtctcgatctcctgaccttgtgatccgcccgactcggcctcccaaagtgctgaaattgcaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgaga

SEQ ID NO: 5983 - DNA, 1577 bp, Homo sapiens
accagctctaattccagaatgtgttcattaccccaaaaggaaacactgtacccattaagcagttactctgtattcccctcttccctaatccctagcaaacgccattctgctttctgtctctaatttgagccaacatcgaggaagagtactctgtacaattgaaattgcagaaaaaactttgggatgtgattgttaggaataaaaaaccacctaattctttgcatgcttctctaagtacagtagacatgctgccagggactctttatggaagaaaagttgagactcatagaagtttgcagttttgttttgatcaccccagagggttttgctcaaactcttagactcatttgtatttcttcattggttatcttaaattcaaaatggtactttatctaattgaattgaaatcttaaaatttatgagaaacaaaagtcactttatgttcttagtaaatatttctaatggggttataggagatctaagtacaaaaaaaatttaaaattttgttattaatctcccctccttaaggaaaattttattaatatacataattataacagcctcccaagtctggtctcgaacttctcggctcaagctatctatctgcctcagtctcccaaactgctgggattagtcatgagccaccgtgcctggctgtgacccattttagatgacaaaaactaattttcaatgctaatacgaattggttgttaaaggtgaatataattaaactgaacattattggcatcctaaatcctttattggccataatttacctttggattctattcaaactacactttgatctgtagaacccaaattggttactatatgaacttgcatcttcctaaactcatcatgttaaaaattttcacagcttgaaaaatggaggtcctcatatcagtctcttgattttcttttgaggtaagctgtccctctgtgcttagtccttgactaaaaataatcgtactgcttatggtcttgatttgacttttctgtatactggttacactggctcaaaagtccatttttgtggagactcttaaaaagtagtagtcttccacattcaagtactgtacttgaaaaaaaaaaacctggatttcagctttcatttagaaatgctttccctgtaattactacttttaaaacccatattttatatgtcaatttttacattaattaccccattgatagcagtttttgaatggttttagttaaaactgtcaatcttctttgcttgaatctagcctctcattaagtttatcaaaaactttaaaaagtaaatgtaagactcttcatatagtgttttttttttaattgagttatggattctttggatttattcattatctgagttagttttttcagaaatgtcttcttattttgtaggtctgtggttgatgaaaacctgttcatgagggcacaaaagactcttccagtttattctatcactataaaatagaatttgatggatttcgaagtaagtagtacagataatattcttacaaaggcatccataaatagtgaagtggtagcacctattcccccatgattgacattcattaattaatccattg

SEQ ID NO: 5984 - DNA, 1949 bp, Homo sapiens
gtataatccaggagtatccaaatagacatttacttctttatatgcagcaaaacacatatgtgttaatggtcccctgagctatcaagtaaaagggactcctggctaaggaatgaaattacatatggtttatatagttatatatagttataagagtgtggtactgtgaagataaggtaacaagtttttatgtcaatgccaattttcagcgttcacccattgccccagatacagttattcattctctatcaactgtgcctcaccaatatatttcacattcttataattacaaccattctactttagacctttttttttgttgttattttgactattgcagtggcctcaaatttcgttcctccactttcattcatcttgctcaaaagctacccaccataatgatggaaaattatcttcctaaaatgcaaattattaaacttttgatagatctggccccttcttgcctctcctgtcccttctactagttatccaacgcaaatcatacatttccacacgttcaccatcattttctagtttacacactgttgtcttttgcttactcctaatagtttttctaatacaccgtacttttccctgttttacctgactgtacctacacatttattcctttagattcagtttaggtttaactttttttcggaacacctttcctgattcactatgcccaaactccaccatttcctccagactctccatgttcccaatggtgtgtgtgtgggtgggtgtgtgggggtgtgtgtgtgtgtgaatatcattcatctgtctccttcactagactgtaagcagctggagggtagagcttgccttatatcttgctttctatatcttcagtgtcagcacttagaaaatgtttgagtgactgactcgtgttcttaatatttctcgctttggggttaccatggtcattcctttacctagggaacaagacgtcaaatcaccatgtaacctgatacattatttagctaaaaactgcttcaatgaatattgttgcaacagtttttctacagactaaaggtattataatgtatacctttttttttgctgctgtctgacctttagtctcaaggactagaatgtaactccatcagggcagggatttttttatctgccttttctattctgttcccaacactaggacaacataggtgctcaataaaaatttattgaaacagatgaaactgcttttttttctttttttagctgttacaagcttctctgtattacattgtttctaatcaatggcagggtataaccacagatatgatttgtttaaataaaagaattttcaaattatttagttttatagcatagcatcattttggccaggcatggtggctcacgcctgtaatcccagcactttgggaggccaaggtgggcgaatcatgaggtcaggagttcgagaccagcctggccaacatggtgaaaccccgtctctattaaaaatacaaaaaaattagctgggcgtggtggcaggtgcctgtaattccagctacttgggaggctgaggcaggagaattgcttgaacctgggaggtggaggttgcaatgagccgagatcctgccactgcaccccaagcccaggtgattgatagtgcgacactccgtctcaaaaaaaatatatatatatgtgtgtgtgtgtgtgtgtgtgtgtgtgtgtgtgtgtgtagcatcatttcttttatgtttactttctcagtgggatataccattggcctttgcctaatattaaaatgagcatacatatccattgccagaacagattccagctaacagcaaagagagctacccacacagcatgctacattatataaaatttggagaaggttatctagttcagggcattgatctgcttagatcttttcatcttaaagagagaaaatacaaattatttttagacctgaaatcaagtgctcaactccaaacaacatttct

SEQ ID NO: 5985 - DNA, 1655 bp, Homo sapiens
ggagaagatatgaggtaattaagggtacaagaagttgagattcaaacatcctccaccttcccaccccccactgccagtgggtgataaggaaatgatcacagacgactgaagtgagctaacatgattgtggatatacccatattaattcataccggaaacacagatgagaaggttgagaaggaatagtaaagaccatgagttcggtttagattcacagagtgtggaagtccaagaggaaggtaaaaaggactgaaggcccagagtcaactgtacagtagtacaagctacggaggtggatataatcactcaagaaagatatggcaaaatggtaagtggtggggtgatggtaaaaagagacaagggtctagtgtggtggttgaaagaagcagctgaagtcagattagtcacttaaattacttgattttctgagccttcgtttcaactgcaagataaagcttacaatggcatcaacttgagatggctggtgcattaaagatataattcatataaagccattagaccaaaccctgcatgagagctcaatgaatgtcagcaattcttaccatagtgtaccattataatgttggcataaaattagattttcagaaaaaataagcttattaacatgtattagttatagaggcttattactaaaaatgcatgatgaaaaacctatgggcaagcaaaaatattttagaattctccacctcttctctcaatacccatactcttaagagttatattaaaggcagacttgtttaaatgtcaggacatttaccttagcttctttcctttagttagcctagtggctcttaaattttagtttgcttaagaataacaatagcaacacagtgtttagtacgaagtcatgcatgtatttcaactaagtagatattttaaggaattttctgcagtaattttgaaaaaacttttatcaccataactggtgattttggaattgaattacccatgtgcccatccacctcccactgcatctcccagttgcagcgggaggtgaacgggcacatgggtaaaattatatattgggtacacatatatatatgatgaaatttaacagactaaaacaaggtttaagaagagttatcttgtccaacatcatatagtcgataagaaacaggatttgaactcgggtctgccttactcaaaggcaaggtctcttttcagttttctctatgctacatctgtaggatagggagatcccaagcaggtttagtacggtgcttcactgaaggaatatcaacatttaagaagatggtggagagataatcgtagactatggtgtgcagaagccaacaaaggctgaagtaacatacaatcttcaatttctactgaaatgggaaattttgaagacactaataacccttacaaaggagggtgaaaataaaatatgaggcaaacagtaaatctcaggaatgaggtagacgaaaaaataagcgcagcatattgactaaagcacatttcttcctctatagtttgggaactgtgtcacagtcggaccaatatatggctctaaccaacatgtagcttttcttttcttttctttttttttttttttggtcttcttaatttgaggatttagcattccagttgtcatgtttgatgccattctgaaataaatctcttaggaagaaaaa

SEQ ID NO: 5986 - DNA, 470 bp, Homo sapiens
tgattcagccctttaatcttccacgggagcagttgagcgcggggcgtggcgggcggccctccgtgcccatgattcaggggcacagctgccccagcagacacacactttcatacgcactcacaccccacccccagacacacccccaggtctctggaactggcccagggtcctgctgctctcacagccgcagggacagggctcaagggctaccctcacccccacccggcttcctagcgccctggacgcccacggcccctcttggacttcttggtccctgaggggggacggatggggagaggggcggtggtcgagggcggcggcggtggcaggagtggaggtagaggtagagtttgccaccagtctggaaggcataggccagttccacaataaaggggtgcttcactgactctagaatgttccgctcagcccgtgtgtgtgctgtgtccttggcattgcgcacaattttggcc

SEQ ID NO: 5987 - DNA, 4484 bp, Homo sapiens
gctctcgtctcgtcggtcgcggcgcctgcagtctggaggcgcaccggagcggccggggcgtcccccgcgggagcccgcagccacccgggacgcgcatccagacgtggcgcttcggaccgggcacgctgcgcccgggggctcggcggaccccgcgtagccgccgcttcggagcttgtgcggcgcgggctggccagcggggcggccagggcccggcccgcctccccagcgcccgcccggcttctccccctggcggtgggagcctcggcggccgctggcgacactaggcgcactgaagcccgagccgagccgagcccgagccgccgccgccgccgccgctgctgcgcaccgctcccgggctccctcccagcgcgccggccggggtgtggggggcggcgggccggaggggcgagggcgggccagggggcgcacacgggggttggcgcggaagacaggaccctcagcctcgagggagcccctaggtgaccaggcaaaatggcagttccttccagctggtcctcagatgggcacatctattagcctctgctcttgtaagaagttagctgcagaacccacatgtgaatccttgtaggactctggagaagatcaaatgggagcttagatgtggaagctctttggaaaccaagaaacactctgaaaatgaaaagggaacagtttgtggacttgcgctggcccttggaccacacttcgagtgacattgttatagatgacacggtctcttataggaaaatgcacagtctttcttagattctctacctccctcttccatctcattcccaacatagatctgggtacatgagtggggtcttattataatcttgtgacacccttggatcatgcactaccctctaaataatcaatagtttctactatagagaggctcaatttatcttctccctggaattgggaccactgaaatataactagaacccaactgatcttttgagatgttgtgtgcttgcccttactgctactgccgtagttctgaacatttccccaagcatcaaaaaggccccatggcctcttttcccctagacctctgccagtccaccaacactctcagtggggaagtaagaagcctggtggatcctgcttcccacacaaaggccatgatgagacagatgctttctaagtccgatatatctacccactttctgctgtcacctctgtacctcctgagtcacatggaatgtggtgctgagccaaatggtcagtcttctagaagcagtggaatgttggaggcagcttataccttagctgattcttaaattttcaggaattttgtgagccagtttttaaacacagccattgttgaaaattaaacaatataaacttataatcaaatatattaaaaataaagataatgccctcaactcatcacttcctatttattgttttacactttagtactatctatgcttattgtatgtgtatggtggaaatactacataatgatatttaatggtgtactgccacacagctcttcacaactctgcattcagtgacatcactttggtagcttgaaatcagccatgataggagtatttatatcttggaaattggcaaatattacaaatcagcattccaccctcccttacctccccaccccccagccagttgttaaacatttaccagcatgcaaccacccagagcctgcatctgggaaagtgagccactaacccaatgacctgtgataaccctatacatatctagctgttactaagctgcccttcccataacggtctgccccaaaaaggtgtgtgtgcagaggagaataaaaactaaaaccctaagatcatcttatttacttgccctatttctgcctcttttctctccctgccatctctggggtccagaagtagaagctttttattgcctccggagtttattcttatacatcaaggataaacattcatgacctaacatcatctctcttgttttctcccgccaaagctataaggatagtctaatcatgaaaaaacattaaacaaactcaaaatggggacagtctataaaatacctaaccagttctcttcagaacagttaaggtcctgaaaggcgaggagagaagaagaaacaatcacaacttggaggacattaatgcactaaatttaatatggtttcataagttgggctgaaaagaaaaggacagtagaaaagctgggatatgagaatacagtctaagtgtagtactaatgttaagtttttaatctctaacttgatggcatggttatagaaaatagaaacattaggcaaagctgggtgaaaggtatacaggaactctactatctatacaacttttctgtaaacataaaattatttcaaaataaaactaatataagaaaaaaacatggccgacataacagatagaatggatatcttctctagtctatgaaaaaccctgtgtcctacattcacttgctttgtgatataataaaagggggaaaggaagggatgatagaaacattattcctcttaataaacttggattttaaaatcttttatcttttcacagcataaaacattccacttaggatgctatatgttgagcattaactttctctttttctttatagtctttctgtaatagttcaaatcctgcccaccctgagggtggatgtttctagatgatgaaggaggtcataaacagagagtagattaatataattatctttatttcatgtctatttgcaaatgggccattgttcacatagttgtctctctttctaaatggaagaatagttggagttgggggtggggaaataccagaactgagaggagtaaaggtgcttcaagacaatgcttcttaaactttggttttgtgtttgcatctcttggggatcttgtttaaagtaggttgagattcagtatgtttggggaggggcccgttaatctgattttataaaaagttcctagatgatgccatgctgctggtctctgagaagcaagagtctggggtcctttctaaagtgtttcctctctcctctatacagtcagaaaaggaaagtgcttactggtcagagatttaaaagacataggagatataccacacttctataagaccagaaacaaaaacaaagaaagaagaaacataataaccaaaatatgacattattgcacacaatgagatgcagtaaaagatggactacttaggcattcactggacataagtgaagctgcctttggagtttaattttaagttctcagtaactcactgtatttagtcatatcgtttcacatacagacaaaattccttctctactaagaaggaactaaagctctcagaattactgagttgcacagtaccaatttacatgaatatttttcttcctctaaaagtttgtaatgactatggttcctggaaaataatatttcattttttcaattcatactcttaatctaccaaaaaaacactcttccaaaaatataagctagaaaaacaggtaatttgctcatatcatagagacaactcataccaataaaaaaatacattttaaaatttggaaaattacaatgagagaataaagcattttgcatgcagatgtgttatgtttttactccacaatattgggagcttccaaagtgtaacatgcatttacagagccactctcttagcatttaaactgggaggcatttttcgagaagcatgagtcttgctcagcggtcctgtagccactctagcaatctcacacagtacatgacttataaatattgtatgtgcttgatggaagtagacctggctttgctaatcacttaccagttcttttgcccagtatttctttgttttagaagtaactttgtttagcttaccaaatgtatattgtccaatttgtaggaaatataagtaatattgcaaacagcaaaatgggattgtatgtgcagatctctgcatcctggtgggccctgtcatgttagtaatagcttttccttgtgctgttgccactgccaaacagactgcttatgcgatctttggctttcttaactcctctttggggatcaataaagtgtttcttttttttcttagataccaacttcatctctctttaagaatacaatattagtttaaaagattgttcaacttaaagcaatcttgtagagattgtcacccatgattgatgctgggtgagtagaaaggaaaatgttgattttatcctctgcctttcagatctttgaaggggaaagtgggctagttttttaaactgcagcctgatcaaatgtttcaaaagttgttcaaaagtaatcttagtccaacactgctcctctgacttttatctagagaaatagaaaagtttatatattaacgatttgtttcttttaagtacttgtgtacatttttctcttgcaataagtattaataattgaaaattattaaattgtcattttaatgttttttattaagtaagtttgatatgtttcttagcaacgaagacctgtggctcaaataggagcagacaattcatggaatc

SEQ ID NO: 5988 - DNA, 728 bp, Homo sapiens
ggaagggaggaagcgtagaaggtgccgatgcacttttcctctctccagccctcctgactgctccaagaatttcatcgaacaagactcaaagaggcccagctgctctgcgttttgattcttctccctctctcagtccacactgacctgggaggggcttctcaaacaccacatttcctagcgtgctgtgagaagaggactgtgagctaagaagggagaaaaggcactccctcctcatcaacaaacacctgacctgggtagaccctctgcttaccaagatccagtccaccttttgacatcagcattcatgctgcctctttttacgaaccaagccaaagtggtcccttcctctggaaattataggatacttaatgtacatcatatccaggtatgatactagaactttaagcctggtaagttagttacattttataaaagcatcttatcctaagattataaattgatgacaagcaagaactgatagtacccagcatgtgtgatatccgtaagtttgatgaactgatgaatggattacatgacaataatctgtccatcatggatagaaaaagaacactactattctcatatctgctgtacccatattcatcttcataaaaaatgtttcaagttttacaatggagaaataaaggtgtttccatccacttccctctaaaattacccccaaacaggataaaaaaacaaaaacacaaactccatcttccatgaaacaa

SEQ ID NO: 5989 - DNA, 1925 bp, Homo sapiens
ttgcaatgtaaaaatatatcttggtctctgcatgatgatatattaacatctataccatggaacttttaaaaggaaaattgtgtggtataattaaaagaatattgcatgttatagagaaacttcacctgttgatttagcaggtgccattgtgtagatgctaagcaaatcttaatatgtttccttggatttttgaaatttgaatttgttgtgtaactttgctagttaaaagatttagagggatttggctgggcgcatggctcacgcttgtaatcccagcactttgggaggccgaggtaggcagatcacgaggtcaggagttcgagaccagcctggccaatacagtgaaaccctgtctcttctaaaaatacaaaaattagctgggcctcgtggcgggcgcctgtaatcccagctacttgggaggctggcaggagaatcacttgaaccagggaggtggaggttgcaatgagccgagatggcgccactgcaccccagcctgggtggcagagctagactctgtctcaaaaaaaaaaaaaagagtgggatttatcatagtttttttttcttaactgttattgactatttttaatttttattttttaattcagtggcctctcaggattattacctgcatttttttttcaggaaaatcccaattctgcaactaactctgtggccttagacaagtctcttgccttatccagggctgtttccttgtctgtaaaataaagagttggactagatgatctctaaggtcccttttacatctatagtttccttggtactatattagtgtttgagacaaaacaatttaatatatctaagccagttctccctgttatcgttgttgttttctatcattttatcattggaaacaacttggatttggttatggtaatttatatgatgcctcttggtacagttttgtgtatagtgttcctacatgcttgcatttgccagtacaaattacattcagcctataaaatagagatgaacttctgtattcaccagcacttcctttttccaattgtaacttttcattttccttctaaattcagagttttaaagtagaagtacttgctagtaatgcagatagagtcagttctctcaccaatatggatttaaattgtcctttccatctcagtttactcttttttaaaaaaaaaacaaaccaatatgctacctgaaactagaaacacatttttaattctgcagctctcctaacagattattttgctttagtacagagctgggctgcaggctgagttgggagttggtaaaggattgaggacagcaatgtaggtcgcctcttcctacaggaaaaaattgaggaacgttgtgtattactggttaaaagattgattaggattatttcaagggatggttgagttgtcgttttacttatttcacccaatattttgtgtctctacttaagcagtgttgttttaaatgttactggataattgtaacataatcaaattaaattttatatttaactgatacccaagcatttgatgaaaacatgttgcaggaatgggagagtattccatagcttttgttttattgtgatttgattaaatgtgacaactaatagtttaaagacaggacttcactgttttagctgatttcctgtagaaagtgtggctaagtttaattgaaagaaatgtcttcttactagaactgattttgggggactttatccactcttacttggaacactaactgttggcttataagggttcaaaaaggaagcaacagttgcttatttggcatgttgaaatatcactggctattttagagtatgaagcaaactttatcaatatgttttcttttccctccttacacacaatgtagactgatagaaaattagttttagttcttctagaatttatataaattttgtaagctccacccaacacacacacaca

SEQ ID NO: 5990 - DNA, 800 bp, Homo sapiens
gatacctcacttgaggttgacaggagtggccagcagttagtgcctatggtcatgtaatacactaagtcaatacctgtggagtgaaatccggtctctataaaaaatacaaaaaaaatggcgtgagccaccgtgcccagcatggtatttatgattctaagtgccatttcaaaaatctgtttgctcttttttattctctggtccactaaagagtaatctttactgtgggctttatttcatatttttatttgtcctaatactaagtggtagcttctcatttctctgtttcttgattttggagagcaagtctatgcttatctatagaaataatcagtttgtaaacttatgttctccttgaagagtttttgaattttcatgtggcaacttatttttctgttcacattcttgacagaatagaccctcccaggtcatctgcacttctgatatcttttgaaagtgaaatataccattaaaaaaaagtccagctatatgatgaagctgtcacgtaatattagtatattttctatttcaataacaaggtgatctgattttgtacaaagtataattaatgtaatacaatctgcccaaactttggtgcttccttttcatttaattcatatatcaaaataaaaatattatgcaatactagaaaatactcatggccattcatagccatgcagtcttaataaggctaataaaaatagtgactttagtctgtaatagtcctgcacatagccgccttatatttttaagaattttgttggtttctgagattctcaattctcttttatctctgatcagat

SEQ ID NO: 5991 - DNA, 701 bp, Homo sapiens
aatttaaatcatttaattatttaattatttttattaaaaatttttgacttttagcttcaggggtacatgtgcagtttgttacatgggtatattgcatgatgctgaggtttaattttgtactttccttgctgttcctcattttcttcaattctacatttattaagcatgcactctgtatttttttctcactataacattgccagtcctccttcctttcctctcttcctccttcccttctctcttttcttccttccattcctttcttcctaactccctcctcttctctttcataagagtgaagatattaaaaaaaaaatcaagcctaagtgtgttgaaaacctctgagaaaaggaggtttagaaacctgagaaaaggaggtttagaaaccttagaaagaccacagggttaattttgtgacctatttttatttacattagggcatattaaaaacaaattcttttttgttaacattcagaatcagaggtggggagagtggtggaagggcctgtggacttacggatgctgctgcgacactctatgacctcagactgcaagtaagagccaatcccgaagcggtttgttgcagccacacggaacacatactcatttccttcgagaatagacgccttgatggctcctctggcagttcttgatgaccatggatgagctaatggctgtggtctcaatggtggcttcttgag

SEQ ID NO: 5992 - DNA, 10062 bp, Homo sapiens
gtcgctctccagcgctccttgccgcccgcgcctcggcttcaccggcctcgccccaaacttaaaaacacctgagcaggaggttgaacgattccctcggaatctctcctcttcactaacccagcgaaccaccccaaatgcccctatcctcccccaaataaaatccgcagagcaattaacaaagatactcggccaagccccggtttcctcatctgtccctgccccctcgaactttctgtgcttccccagtctcgaccagggacaaactgtgttgaagctcaatgactttctggcagaagtgaacctccagcttcgttttctgacagccgtggttcttcacaggcctggtttcccactccggaccctccactgcccctggtggcggccaccatcttacccccagctccagggtcgcgctgaggacgcggccagcccccagccgccgtagttttgaactacatttcccaccagccctttctcaacatcgcgagagttccggagagattgccgagaagacttgcgcgcaggggcggtctcgcgttcttttcgaggtcggccgcgtggctggaagacatggccactccagtcggtgttgagcacggcgagcagtctcaggcctttagtgatgatggtaaggctgcctgggtgggaaaacggggtcttccttgacacgacactaacatacttggcttcccttcctcagagacgaagtggtgacgataatctcggtttctccctcatagggtggttaggagggttaaaagtactggatgagaaaatgctttccaaacgttgagaaaatgttactatgtgaagggagagagctcaagcccgtcctcggcgtcatagggccggcttctgcgggggagagcgcctaacaacctgggcagccccgtgcgcctccgccgcgcgtgtgctgagcgtcatgcccaggggtcttcggtgcccgcgcacgggcagactctgacgatggtggttcttaattcagcatcaggagtgttaacgtgtgaagacgtgattccgcttggagtgtcttgaggacggccccaatcggtagttcatatttagctttacagataggagtcaataggattgtaaacttctggaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatggtaagaaattactcaaaattcagaatgctaattattttaatgataaaaatgagtagcgtctttgcccgtgtgatttggggccactaggtgtcattgtaaccagcgtggatcctcgttagggcatgcagggatgaaagagacatggcaaatgaattttggatcgctaggatttaggaatctttgttattggctgagctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttagattaaaggtggtggctgtggccttgaaaacagtcatgtgaaaactcatcaccttaaggtgttaagtgtaaggatcttcatgatgaaatttctgtaaatggtgagatttttagtactttcatagacttgaatatgcttatggtcctctttaagtattggtttgttagttttggggatgtgttggtcttccagggttacgattgcccagataatggaagtagtatggaattccttttgatagggtccttgccaagcactctcataaagagcattttttgtttgtttgttttgagacagagttttgctcttgttgcccaggctggagtgcgatggtgcgatcttggctcagcgcaacctctgcctcctgggttcaagctagtctcctgcctcagcctcccaagtagctgggattacaggcatgcaccaccacgcctagctaattttgtgtttttagtagagacggggtttctccatgttggtcaggctggtcttgaactcccgacttaaggtgatctgtgctgggattacaggcgtgagccaccttgcctggccataaatagtatttctaatatcaaccccatatgaggtaaatttttttccccactctgctgctgagtaagtaaaagtgaggcgtaaagagttcttttgcccaaagttatacaagcagttactgagttagactggcagttctgaactggggagcgatggtgttcctggcatctggtgaatgctactattaataaataccctggctgggcctggatatttatctcatgcctgtaatcccagcactttgggaggccgaagcagatggatcacctgaggtcaggagttcgagttcgagaccagcctggccaacatggtgaaaccttgtctctactaaaaatacaaaaattagctgggtgtggtggcgggcacctgtaatcctagctacttgggagactaaggcaggagaatctcttgaacccaggaggcagaggtttgcagtgagctgagatggcaccattgtactccagtctaggcgacaagagcgaaactctgtaaataaataaataaataaatatcctacaatgcatacaacagcctgcatgaggaataattgatccacccagtatgtcagtagagctgaggttgagaaactcctgtataccacacgttaggctaactagagatctgagctctagtctcagcctattttctcaccagagtcttgtttcttcatttgtgaaacagggttagtgatttccaaacttgattattacatcagagccacctacaaagtgttaaaatatacacattcctgggcctcacctccaggcatgggtgagaatggctctggagtggagtccaggaatcatgtggccagtccaagagcaagtgggtagtaactagatcaggggtgtcaatcttttggcttccctgtgccacattggaagaattgtcttgggtcacacataaaataaactaacactaatgatagctgatgagctaaaaaaaaaaaatctcataatattttgagaaagtttacaaatttgttgggctgcattcaaagccgtcctaaagtttacaaatttgtgttgggctgcattcaaagccgtcctgagccacatgcaggctgtgggttagacaagcttgaagtagatgatctgatctgtttttagtgcaaggattttattatagtgagattatagtgctggctatttttaagtagctcttgggcaaatctctaatcctctgtcttaaaaaactgaaagcctggagggcacggtggctgacacctgtaatcccagcacttggggaggccgaggcaggtggatcatctgaggtcgggagttcgagaccagcctgaccaacatggagaaactccgtctctactaaaaatacaaaattagcctggcgtggtggcgcatgcttgtaatcccaacttacttgggagtctgaggcaggagaatcacttgaacccgggaggtggaggttgcagtgagccgagatcgcgtcattgcactccagcctgggcaacaagagtgaaactacttttcaaaaaaagaaagtcacatgcttgctccacaaagaatttgcgtgagggaagtgaacaatttgatgagaaaaaaatagtttgcgtgtgctgtggctgttagtgctatggtccagcaggttggtgggagctgagtccatgatgatttcaagttatccctgtctgaaggcaaagaaaggcctttctgtgtggaatttgaatatctgaaactcagtttcccaagtttgccttacagaaattttaagttacttgagagttactctgtgtgtatcttcttaagtagttttttttcttaatttctcttcccaggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcagctgagttcaaatttactgacgccatgatatgaggatgaaggtttattacctggtgacatcatcctgttggtgacaaggtggtgatacatctctaatgggacttccctcagtggcaggcaggctgccaagcaactaacccccatcaagtgccagaccctcccagtgttctgagagtcatctccatgctaaacagcctgcgttttatatgatttctctacccagccaaaaaaaaaaaaatggtccatcatgtacgcagttatctagtcttaagttatattctggcttttttctcccactttattatggagcagaagtaagcctatcatgttcttagaaaggctcttaagaggtgtcctggagtccttgaatcactttagcatctggggtaggatgtgccaccaggaggatttgggctggagcgtgtgtgtttgcctttgacctggactgctgtctgatcttgctgaacactccaccgacatttcctaaagttgctcagtgccaatccagcaaagcagtccattttcccttggccaagattgagatgtattgttttagatacagaagagttcttggatgagccaaggacaagctggggtgtcctatattgaacagacctcgatgaaaatcttgaattcaccccagtgccctctgttggcaagggaaggtgaagattgaaaagttaaaaaagcttttggccacttgagaggatcagggccgcaactcttgaagaagcaaagggctcagtgcattggggtcagcgctggtacagctgaaggatgccggccttgtgcaggtccctccacagggcagcttccagggacagatcgtggtttgcataaaatatcaatggcttcatttttcgttcgaaatagtggtcggaaaatttccagtagttgcttgtgatgaatccataggcactgacctgggcaaggatagtcgctggattagtatttgttgagcgtctagtgtgtacagacacttgggtgaagtgacatgagtttagaaaggtgtccgtctgctgaggtgaggataatggtctagggcttattcccacttagcaagtggggagatggattcaggggtgactcactgtgtccccacttggcatagctggtgattgccagagctggatttggaactcaagggtggaggcaaaagcccattactactctctccatcctaactggggactgcagtcaagacactcctgcatcagaataggaaaaggccctgtgtggtggctcacgcctgtaatcccaacactgggaagctgaggtgggaggatcacttgagcttggaagtttgagaccagcctgggcaacatggtaagaccctgtctctacaaaaagtaaaaaaaaaaaaaaagagctgggcgtggcagtacatgcctgtgatcccagctacccagctacttgggaagctgaggcaggaggatcatcacaccactgcacttaagcctgggtgacagagttgagaccctgtctcaaaaaagagggaaaagatttaggtgtgagtcgtggagaggcatttggcccccagctctccataccagctttagcatgggtcacggcctctccttgaaagctgctgcttggcccctgcctccatgagcttcacgtgggtcatatcccatcaggaatgactcttaacggtgatttcaaagtagttgcatgtgggaggctaaacctgctgccctaccccagctctaggatgtccccataaaagaatgtccctatttggcccagtatgttgaggactttggctttcacaagggcagtttgatgatttgagccttaaataccatactgagtggctgccttggagaagagtgaaagaaggaagcctggggcaggtgtcaggagccaaggcaagcctgaggcaggtgtccggagccaaggcaaggctggcccaggacctgtccttcaaaggccccagggttgtgggcaaggaagtgagcagtaccagcagcactcttggaactggggattccacgaacagaggccaagagtcccagctccgaggtaagggatatcaggggatcctgttgggttctgttatcctgtgttctgccggcatgggcttctggaagagaaggcctcttacctggtcacaggtatgcaaagctgtcagcagcatgagagccccggtactaggcatatataggtctccaaaatgtgtgttaatcaactttgatttcaagaacctggaagcaaaaagagacatttcagctcactagcttgatggctatcatcacacttcacaactacacattcaaataggtgggaaaacttcaaaaactgagggccttctactccagtcagttctttattcggtccaagtggactaaatacaaagatctttgagaccttaggtaaggttgggggagggggtggtgagaaaggaaccacaggttcccccttttggcaacagcttgttttcaccccaagctactaagtaaccacactgccaagggcataggtggcctgtttatttagcctgagactgcagtttctctctactccacatcttgattaagtaggaatcacgtgtgagggacagggagctcagaccctgtgaccggacccacacagtccaagagtgaggccagggtgtgaccacgggctctgccctcaggcctgagttcacatcgagctgtgccaggccgatcacctgacctctcagagcctgtcttcctctgtagcacgggactaattagaggggcttcatttgcctccccacatccacacacccctctccaactgctccctgccctgggattcgagcctctggtccacagcagggtttctcagtctcagtgctgttgacacttggggccaggtgcttcttgtgatgttcagcagcatccctggcctctacccactgatggcacttgccgccaccacccttgtgacaaccccagacgaggaccatatgcacatccacattgagaacccctggcaggagggagggaagggggttgaggctggtccccgggttccttccggcaccttgtgttggctgtgtttgggcctgaaggttctgatgccctgctgctgacggcgccactgctgctgtgcaccttatggtcccagctcccagtctgtgcctttgtataaacctccttgagttatcctgagtttcctgtccatttcctggtgactgacatatatcaccctccctctatcaaggtgctaaataaaacagtaaatgaagtgacagtgctttgcacacagcactcgggacagtggagctctggttatcggtcagtgcgtggggctcgtgcgagggcgctgactggatgtgggtgggtgtgtaaaagggggaaggaaggggacgctgttcttcaggcaccccactccgtacctttctgtcaggtagctgatgaagtccggatgtagcagcttgaatttactggcagaggcttctggtccaaaataggcgtgcggcctaggacccatgatagaagtggacagagcgcccagagccgtcgtattgcaagggggagatggaggggagggtcagggcgccggagtagccgcggtaccctgagcggtaggagcggggctgggagtagtagcgggagaagggggtgtagaaggtggcaggcagtacgttggggaccacgtgcggcttcccgctcaccaggacctccacgggcgggg

SEQ ID NO: 5993 - DNA, 439 bp, Homo sapiens
ggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcc

SEQ ID NO: 5994 - DNA, 3140 bp, Homo sapiens
ctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttagattaaaggtggtggctgtggccttgaaaacagtcatgtgaaaactcatcaccttaaggtgttaagtgtaaggatcttcatgatgaaatttctgtaaatggtgagatttttagtactttcatagacttgaatatgcttatggtcctctttaagtattggtttgttagttttggggatgtgttggtcttccagggttacgattgcccagataatggaagtagtatggaattccttttgatagggtccttgccaagcactctcataaagagcattttttgtttgtttgttttgagacagagttttgctcttgttgcccaggctggagtgcgatggtgcgatcttggctcagcgcaacctctgcctcctgggttcaagctagtctcctgcctcagcctcccaagtagctgggattacaggcatgcaccaccacgcctagctaattttgtgtttttagtagagacggggtttctccatgttggtcaggctggtcttgaactcccgacttaaggtgatctgtgctgggattacaggcgtgagccaccttgcctggccataaatagtatttctaatatcaaccccatatgaggcagaggtttgcagtgagctgagatggcaccattgtactccagtctaggcgacaagagcgaaactctgtaaataaataaataaataaatatcctacaatgcatacaacagcctgcatgaggaataattgatccacccagtatgtcagtagagctgaggttgagaaactcctgtataccacacgttaggctaactagagatctgagctctagtctcagcctattttctcaccagagtcttgtttcttcatttgtgaaacagggttagtgatttccaaacttgattattacatcagagccacctacaaagtgttaaaatatacacattcctgggcctcacctccaggcatgggtgagaatggctctggagtggagtccaggaatcatgtggccagtccaagagcaagtgggtagtaactagatcaggggtgtcaatcttttggcttccctgtgccacattggaagaattgtcttgggtcacacataaaataaactaacactaatgatagctgatgagctaaaaaaaaaaaatctcataatattttgagaaagtttacaaatttgttgggctgcattcaaagccgtcctaaagtttacaaatttgtgttgggctgcattcaaagccgtcctgagccacatgcaggctgtgggttagacaagcttgaagtagatgatctgatctgtttttagtgcaaggattttattatagtgagattatagtgctggctatttttaagtagctcttgggcaaatctctaatcctctgtcttaaaaaactgaaagcctggagggcacggtggctgacacctgtaatcccagcacttggggaggccgaggcaggtggatcatctgaggtcgggagttcgagaccagcctgaccaacatggagaaactccgtctctactaaaaatacaaaattagcctggcgtggtggcgcatgcttgtaatcccaacttacttgggagtctgaggcaggagaatcacttgaacccgggaggtggaggttgcagtgagccgagatcgcgtcattgcactccagcctgggcaacaagagtgaaactacttttcaaaaaaagaaagtcacatgcttgctccacaaagaatttgcgtgagggaagtgaacaatttgatgagaaaaaaatagtttgcgtgtgctgtggctgttagtgctatggtccagcaggttggtgggagctgagtccatgatgatttcaagttatccctgtctgaaggcaaagaaaggcctttctgtgtggaatttgaatatctgaaactcagtttcccaagtttgccttacagaaattttaagttacttgagagttactctgtgtgtatcttcttaagtagttttttttcttaatttctcttcccaggtgcagtcagcctcagtttccaaagccggaaaaggatcctctagtagccacggtgtggcagctgctctgaaccaggacctggacccggacccaaagtgccatgtctttaatgtgagtaagtagacgaactggtaaacaggcttggtttggtttgggggagtggtaatcttttttgcttcccctgctctggacttaaagcaatgggggcagggagactttagtagcattttgttgctaggtgtctgcaataagagacgaaactgaactgctttgccggaaacaagtgaaatgattgctttcctgtttgtaagatttgtttacatctttcgtatccgtaagaagtcccacaagcctatgatggttagttatccctgtctgaaaatctggactgagggaaataatctattctgaggcttaagggtttggctccatggttttttttttgtttttgttttttttcccctttttttttccctcagcatatcctgctgagagcccagtctagagcatcattcctctaaaacgtgaaaagcaaatgagtgattgtcctgctttctctagtcctttgattatggctctgaggatacaggctgtatgaggtggcaggaatgcacaagtacccaggatttgatttatgcccttattgtggaatgaaagtgcttgttacatatttcaagaaaatgaatgcgctcttagaaacagattggaatgtaggatgtatgccagcttgtggcaatgagaatgcttaatgactctgaccttgcctctgctccagggtcctgacatttaggggaaaccacggctgtttggtttctatgtgctttgttaaggacgccagggaggtctcctaagtttgtagcttagatcctgtctgaatgtcacgactggcatgtgagcaagaaagaaaccaagtggtgctggagagtggggtgcccagctttgttcccactggaatgccaggcttgaagtgcacacagattgcctttcttttctgttgaaaggggaggtgtgggccgggcgcggtggctcacgcct

SEQ ID NO: 5995 - DNA, 2578 bp, Homo sapiens
ctttcccgcgcgaccggcgagggaggaagaagcgcgaagagccgttagtcatgccggtgtggtggcggcggcggagactgcgggcccgtagctgggctctgcgaggtgagagtgatcgcggtcttaggtccaactcctctacgtgccgggttcctccgccatatgggtgcccagcgcggcccctgtcccttccccgggcgcagcggagcgggcggctgctgcgtaggccaaaaggctacgctcccggtgcccccaaggcccacgagctttccccacaagccatttgcgcagtcgcgttttgtgagtaaccacctggaaggcttagctgacctttctccgtcaacaccggttcgctgtcctctgctcagaaactgggcaagggccttctgacttaaggaggtgcctgcaagggaccgtcgggaggcttcgtgctccacccggtcttggccagatctctcttgtgtccccagcaaagttgtgcgtgcggccttggcggtttcaggctcttaggcagcttgttttccttaaaagggagcgttttataaataggaaggtgattatcccttaggtgtcaggacgacccttagttaaccgtactttgtgagtggctttgaaactgtaatgagcgcagtttactgagtcattactagtctcgacccattcgtagagctagtcagtatttgttcctggaccttccttcgtaatacgcgctaaagtcaaggcatggaggttggagaacaacacgtgcaagtataggaggcccttaggctaaatgcctgctacacacggagatgcttgtatttacatagagatgtgtatttctggacataatacagaagaaaccggtcagcaactgggaggctgggaaaacctgttagctattcagaaacttttttttttttttttttgagccagagtctgttctgtcgcccagggtggagtgcagtgacgcgatcttggctcactgaatcctccacctcccggggttcaagcagttctctgcctcagcctcccgagtagctgggattacaggcgcctgccaccacgcccggctaatttttgtatttctagtagagacggggtttcaccatctggccaggctggtcttgaactcctgaccagcctgaccactcgtgatccacccgcctaggcctctcaaagtgctgggattataggcgtgagttaccgcgcccggccatagaaacaaattttaaaatttcatcagtgagacttcgtataggtttttttttttcttcaaatttgaaatgcattgcttcgtctgaaataatcattaactgtcaagaagacgaatgtcatggcttatccttgaaatattttaggtattattatttttgaggcttcagtagcttgaattctgttttcactggtaagtgctgggacttctaaaaattttcaaactaaataattgataaaattggtagtgcaggaaagttctgaagcataatacaaaagaatccaccgatacatttgagaactataatattaccaatactagggtatctattgtttacatttccctgcttcctattcataggtacccaccatttggaattttgtgcccatcagtcttttgggttttgtgggggaggggggtggtgtggatagctttgtggggttttttgttgcttttttgagatggattctcattcctgtcgtgcaggctggagtgcagtggcgcgatgtcagcacactgcaacctccatctcccaggttcaagcgattctccttcctcagcctcccgagtagctaggattacaggcacccaccatcatgcccagttaattattgtatttttagtggagatggggtttggccaggctggtctagaactcctgacctcaggtgatccacccgccccgaccccacaaagtgctaggattacaggcgggagacaccgtgtccggcccattttttaagctttgtaaagacaggattatgcatgtagttgtctgtagttcctgtgaatcataatattaaactgaaactttttttgtttcagttaattttttttgaattattcaaaaccagtagtttatattcctaatactgattgtgtgaaacattttcagcatttcagcacatgaaaatgattgtttttgcaagctccaaccttgtatgtcttcataaatcatttcgtattgctgcctggctcaatgatttattctcctgggctgctgtatgacatgattttttgccccagtccatgttctttgcagtttttagttaacttgggacttaattttacaggaatgtgtccagtaaaaatgccaatataggtatccctgctctgaaactgctaggtttgccgttataatgtttttaggtgaaggtcttcacgttagtttttatacatctaacctggctcatagctcatccttgtcgagctgtgagacagaaaagcaacggctgtgtactcactatgaccattatgtcttaaaatcaaaactgccacagtgaaggatatcatgaaatacgtgttcaagaaaacatgaacagaagcaaatgatgaaaatgagcattttacttgatgttgataacatcacaataaattatggag

SEQ ID NO: 5996 - DNA, 12515 bp, Homo sapiens
attcacccacatggtccttcgaggtgccgccgccgccgcccgacctgcgccttcgcgccacttcgcgccctcgggcgaggccgagggggtggggacgactaccgcagcgccgccggggctcgcgctcctccgcgaagctctcctcgcggggcgggccggccggccgcacccccggcctggggcctccggtcgtagtaaagcgcaggcgggcggggaggcgggagcaggagcccgcggccggccagccgaagatggtggcggctactcctcctggtgagtctgcccgcccctccggcgacggagggaaacctgttgtgtgcggcccgggtctggcgggcggggcggagcggcccggggcggactggcccggggcagcgtggcggcggcggcgtggccggggcgggtctcggccgttggccgccccggcgtgtggcagccgcatctggctgccccctcgctcgcccgcgggccggcggaggggggcagggccggggcgggagggtgggagggggcggcgtgcgcgtggcggccgcgcccgggacccgcgcagaccctgcctgggccgacccgaaggcgggtgggcggacggcgaacacaatggcccctcggggagaggacgtgcgaggcccgtgccttctccggggcccggggcgcgcgcggggcgtggggtctctgggtaggaaagtttctcccgagggcgagagttaaagcgcctccagaacaaagcggcggcggcggcggcacatggggcaggccgcgggccgggagggggcgcgcccacgaggtacctgcgcgccagcgggcggcgtggcgtgggcgggagcccgcggttccccaaactttgtacgcgcgagggtgggcggaggggcgccgagatcggcgcggcctgggcgccacccccgctccgcgtgggctttgttagcccgcgtgggcagcctcggggcggggcccgcaacttccccgccgtggccctcggaggaggccgcagtcggcctcagccgcggcgtggagccgcctgcgcccggccgcttgctgggagtgtggcgcgggagggccagcccggctcggcgggagcggcgtccccgccgccatgttcctgcggggcgggctgcacgggggtgagggcgggggacatggcggcgactgcgcgccgccgccgattgttcccggcttaggcctcgggccgcgtgcgacgggcaccgcggccgcggagcccccgcccctctgggccgggctcgggggggctgggggacacaaaggaggggcggcgcgcccgcgtccccgccgcactcgggcctcggcgccgccggtcgccgcgcggctgccgccgggaaacgggttgggggggttgccgcgtccggcggggcctgactctgacccgccgccccctggcggctacgcggagaatcgcagggccgcgctcccccttgtgcgacatgtgctgccggcccgggctccatgagcgtggcgggcactttgcagtctcgggtgttcctgcccggtcttctgttcctaaactgcagcaaagggaaaaggaactgaaaaaggcaggctcgtcgttgcaatatcaccaaaagagaaaattaacggcatgccatcaggaccacagcagttggagaaacaactctttatcccggcttgcagccacgaggtcttgattgggggaggggtggtgaagaatagtctgtgggctgctttttttttttccttttactggagctgtacagtggagtcggtgattgctgctgatcataatcaagtattttaggagcttatttagacatgtatctgatagctaaggatttttcaactttattctcttacgtatttttcaactgtaaattattgggcttttaaatcctgctagtattgctcgactcttactctcacaaatggatggaattaattgctgttaggaggttggaaaatagcaaatatagatttggacggtggtagtaattttgagcaaataatgttttatcttttttttccttatttttccctattccagtcatacacgtggacctaactgcaccagtagcttttctgagaatacttgctgaaaaggaagttttctggaatgggtaagtgtattctgattttcttgaacttttcttaaaaacaaatttttcttgctattaaagttgaataaataggattggtttcttagagagtaaaagtaggtgtttctttctttagacaatgtaccttttctgaaaaactaactcattaagtacggatttgctaattttaaggtagtaaaattacagtgtaaatattcctgtacatttttggaaactggcttatgcagtttacgaaatataattttagaccctcttttaagttgggtgataaagtagatataacctgagatgatagatttaaacaggatatttacgttctgctacaattgactgataacacttgaagtgtagtctgaacagtaattttgttaatcatttcaacaagtatttgctaagtggaagccagaagaggaggaaaatgttttgccacgtggatgtgaagatttcctctaaaaggtacacatggactaaattgcctttaaatgttccaaaattagttctcatttatttgcagtctcattttgttttgttttttttctctatgtgtcaatccatttgggagaggccagccattggaagagccaccacttccagtgctagttggatggttggttatgattgccttctgtaaagaattcttaaggcataaatacgtgtctaaatggacctcatatctttgagataattaaactaattttttcttccccattagggattatgctgaatttgtatggtttatagttgttagagtttgaggtgttaattctaattatctatttcaaatttagcaggaaaaaagagaacatcaccttgtaaaactgaagattgtgaccagtcagaataatgtcaaagtgcttacagtgcaggtagtgatatgtgcatctactgcagtgaaggcacttgtagcattatggtgacagctgcctcgggaagccaagttgggctttaaagtgcagggcctgctgatgttgagtgctttttgttctaaggtgcatctagtgcagatagtgaagtagattagcatctactgccctaagtgctccttctggcataagaagttatgtattcatccaataattcaagccaagcaagtatataggtgttttaatagtttttgtttgcagtcctctgttagttttgcatagttgcactacaagaagaatgtagttgtgcaaatctatgcaaaactgatggtggcctgctatttccttcaaatgaatgatttttactaattttgtgtacttttattgtgtcgatgtagaatctgcctggtctatctgatgtgacagcttctgtagcactaaagtgcttatagtgcaggtagtgtttagttatctactgcattatgagcacttaaagtactgctagctgtagaactccagcttcggcctgtcgcccaatcaaactgtcctgttactgaacactgttctatggttagttttgcaggtttgcatccagctgtgtgatattctgctgtgcaaatccatgcaaaactgactgtggtagtgaaaagtctgtagaaaagtaagggaaactcaaacccctttctacacaggttgggatcggttgcaatgctgtgtttctgtatggtattgcacttgtcccggcctgttgagtttggtggggattgtgaccagaagattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagaaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagacggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaactggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaaaatgggtcaacttttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttattatcgcagtttttatggcgtttttgttttgtcactacagatggtctaaaggttacttattaattaattggggaagtggagacaaggaccaaagtttatctggattttcttatttaatcttcattacctgtgaaatatgtatttgtattcttactttacatatgagatcagaagttcattttcaagcagaatggaaaggtggtaaatggactctgaattaaaatatgtcagtattttaaaaggttatcttctgcctagtatttttatggaatctgacaagttctcagatcacacttgtttccttaaatcttggtaagtctgaagcattcttcattttgtttatattatacacgttagtaaggtgggagttcttttgttttttgtgttttttggccagttgataacatgaaagtttaagagaggaggccaaagtatataaaaagtcttaaactcctgcttctaataaatgtccaatatgtgttggctcctgggttgagtgtttattaatgggtctgtactaactctaaaacattaaataagaatggtatgttctgaccagccctcaaagttcagccatttctaaaagttcaaaaaatcattgtaaatattttttaaatgaggtacgagattgtacctgtctatggccagtaacacaagaaatctaggctcatgcagagttttagcatagttgaccctcagtatcagtggagggattggtaggaccctcagtgcataccaaattcttcaggtgctcaagtcccttatgtaaagtggtgcagtgtttgcatgtaaatctatacatgtcttcttgtatgctttaagctgtctatatattgcttgaataatctggtaaaatatcttacatattattcatgtagattcagtatagtatttgcgtgtggcaaattcaggtttggcttttggggacttcgtgagattttttttcctgagtattttcagtctgtttgtggttggatgcaggaaccacagatacatagggctaacttaagtaagtgccgacataaatgcgttagtcatagaggtaaataacaaagacctgagtttggtagtaagttccccgaaatgaaatgttagtatactcctaagtgattagtaattagatctcaggttgaatatactaaatccttaataactgcatgtttacttttaagacctagatttgtcagtatattagtagaggtgagcatgtactaattgttcacacttgtttataaaagcatatatactgtgaatttttagtacgtttaatgttgacttcaacttacatagactgaaaaagattgaaaaaaagcttcgacgacatcagttctgcacttgttgagatgtactgatccagatggaataccacactgttcagcaggttggggtaactagatgagactagtgaatgttccaagagtagatgaaaattggggtcctgtaaggtggtgctaggaattctaaagtgattatgcatttaccaagaaaaggttcttaaccagttgtcttaaaattattaagacgtaaagacctggaatcttaatctagctgcactatattagagtctttggggcaggatgctgcgcagacaagtattttgagaaatacctgttgattttgctgtatatacttaaggatatatctactaccctgaattgttggaaatgctgagccataggaatgcagaagaacatcaaaacaccttagaatttatatgcaggaaagagaccagtaaactatttttatggttcatgcagtcattactcagttttatagctgactgacaaaatatgtgccccaaccccacatttatttctaaatccacaggcttttccttactcttcaatttcagtaacttccctttttcttctccaatgatactttgttttggtaacagcacctaacaggccaggtgtgtagttgtctttgtgctatacctgtatttccttggttggctactgtcacagtggccaccatcattctgaacaagtaaggtgcacaaggtacaagccatgtctttagacataggttatcgtcagcatttagattctcctctaaggctttcatctaaaactcccttggttttgtgtttaaaacttagtccacagttttctagtgttaccctcagaataattgtcaaaattgtactttctaatactcaagattgcatctaaatttcaagttagaaaagatgtttatgccatattctgagtgtcttgtgtttataacctatgattctgcccttgactgtacttacgaatactccttttaaaatacgaaacttgattgagaccccagctcatttactgatgtcttaatacaactgcctttccacttaagtgttttggctcccccagttcctatcatttatcctctccaggcagacttccacttcagactgcatttgctattcccttagtttgggaacttcccactccggatacctatgacttagtcttgtttccttgtagtccttgtacacagatgtcagactggctctcccttaaactgcatactctgttcctgttctctgcatcatcatcctgaattagtggcatcacctgggatattggaagtgcaggtccttcccacccccttccaaacctgaattgggagcttcgttttttaatccccccaattaatctctaagatataaggcctccaagggcaaagatttgaagatgtgtggttcatggatgcttattcaacatctaaaatggtacctggtgtgtagaaggcactgaatagactgaacaggtaagtggaaatgcccgtgggtgaatgttacttctaggatgagacggtctgaaagagaaaagcaaaacaagactagtatgggggcaaagtgcattattgacggtgtggtaaaaagtcattagagcaacgttggtggagcaagaaaacagagtaagtaaaaaggatttgctgtgtacagtaatcccagcaaaaatgaaggaaagcctagaagtgggggatcaagaaaaaaaccaactgatagatgctccatttgtgtggatatgtaatgttcatctgttggaagtaaatgtaaaacccagcttctaaatctcagaaagcaactgacagcagcaatagggtgaatgtgaaagcactgaacaaagtaacaaaagtgctgagaagttgtgctttgtgacagattagttttcatgatgttgcgtggatgtgagaaggctctgctaataggtatagtcaggtgtgttttttttttcggtttggtttgttctctgtattactttgaaatttagactatcaagtaccagaatactatagttttctaactcaggttcactccctgcagaaggttcaggagtacaagaagccctgcactgaatcgtggtgcctcaattaaattttgagttgtccttttggcttcctgagacaaaacaacgtgttaaaccagttacttcgagtgtgtgacatgagaagatggatgatgataaagagaagttgagaaaggcacctcagattaattttaggaaacaaatgtaaactaaacttgaattctattctctttgagtcatgtaatacttggctaatcggttgagaagcttaaagaactatttaagaagtcttacagtgtaatgtttaggacggagaattctgggttcaagtaccagtttcctccattaatagcttaggcaacttaagtgtgttgtctttccccaaaaattgtaagcttaggtaggctttcccatcttgatcaaaaaggtagctatcatgttcacatccagctggaaaataaacctttcctcaacttcaaagtgaattttcagctccactctgcccacctgaactcggtctgaggaacaagattacattcaggcttgagctttgtgtaccatctctgttgacagtaccactgaaagtctgttcccttcctgaagcacacaggatacctaggcaggttggtggcatggataactgaaagatgagaatacaatattaacatttgggggcacatagattttagtgagggtagagatggaagagaggaagggagaggattttcattaagttgataacttgagcacaagtctaaggcaaacattgtcaggcctctgttattcaaccgcacttggcaaggctgatgcagctgctgcttataggtcttggctaaaatattacttcctcaaagccttttctgactgccctcccctattcagttaatctctgccatgttttattcaaagtacttaactacaatttatagttatgtgtatttggatattttgttattttgaattcattacattactgcttttaacaaattgccacaaactttttttgttgtttgagacagtcttgctctgtcacccaggctggagttcagtgacccaatcagctcactgcaacctctgcctcctgggttcaagcgattctcctgcctcagcctccccagtagctgggattacagatatgcttgcaccagcacgcctggctaatttttgtatttttagtagagatggggtttcaccatgttggccaggctggtctcaaactcctgaccttgtgatctgcccacctcgggctcccaaaggccgcaaacttttaatggcttgaaatcttacagttctgtaggtcaggagtcttgacacaggtcccactaggttacaattaaggtgtcagcagggctgtattagtccctagagtctttaggggaggcaaggttttttttttttatcttttcaagcttctgaagactctgcctttggctcacggtctcttactccatcttcatatctagcagcagcaggtggcgtctgcatcacactggacccctcttacctccctctttcacttttaaggacccttgtgattaatattgagcccatccaaatatttagaaataatttattttaaggtcagctcattggcagtcttaattccccttgtaacatttcacatttgcaggttctaggattaggacttggatattgttggaggtcattctgcctgtcttagggaattgtgttggttttggacatggttatagttccaggcatacataactgcttagagttgttttcagacagcgtaagtgaaatgaatgagctaaggaaaatacttaatccaataaaaaatagaacatactcgggctgtctcaatgttttcctacggtatttaagtgccagtttatggaggttttaaagaaaagattttctcagacgagaagagcttataatatacttcctgcaaacattctagaaaatgtaggtccttatcagtcaaccttcagaatggggaaaccacaaaataagtgaaattttgttaacctatctaagtaaacattaaagagttgcttttagaaatgacacaatgtaaagagaccatcagggtctaaaacctcattagccagaactggaaaatgagcttttaaatacaggtaaaaagtaaataagcaatttatcctctactttgttagagtacagaaatagtatttcaaagcaaccactagcagaataaaagactatacttaactttgaaatcaccaggaaaaaggctaggaaaacagcccacaaagcaaaagacaaaaaggaggagacagaaataagaacatttttaattaaaattaagcacagaaaaattttaagtagtttgtattcaag

SEQ ID NO: 5997 - DNA, 464 bp, Homo sapiens
aggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataa

SEQ ID NO: 5998 - DNA, 691 bp, Homo sapiens
tatagaaaacataaaggaactttaatatccaaacattcagggtaaagaatactggattaatcacccattaagtgtaaatcacttcaggttctttacagtaccagaaagtaaaatctaaattttgcatattgcagagaatgaaaccattttaaaaactttaatttccttacctgatactaataccagtatgatttttagacggaaaaactaagagtaagatttaaaccaaagatagaggtgttcctgaaatgtgaatttgttcagtagtaaccttttcatcatgagtactgataccactttcttctcagaaagtagtcaatgtacattttaagatttgtgcaataagccaatatgctggataataaaaactgttattactggagatagtcaaaatgaaagaaaactatttaaattatttatgcccaaataatttaccctgcagtccatgagatgcacaggaaataattttttttaataagagaacaatgagggtcctaaagtagaaacataagccagaagaaatctaaaaatagcttcctgatattttattttaaaatatttcatttaagctgcttttggttgcatgccctgatctgtagaagttaacaaggaaataaaatttccaagtatttaaaaaatttactcatcttccataaagcgacttttaatgtatcaacacttaaaaatacac

SEQ ID NO: 5999 - DNA, 2231 bp, Homo sapiens
ctttcagacctttaatctctgtatatagagatatagaaatagagaatattctttaaatatctgaacatttaagtattactcatcccaatacaatatatacttatacaaatagatatatgtatgtatactatacataaagatctgaggtactaaatattccatggttttttttcattcaacaatgtattatgaatgcctttcaatagccatactttaatagttgcatagtatcacgttgcataaacatattaggtcagtgcataagtaattgcactttttaccattttaatggcaaatgaggcactgattaatcagtgccttatttttcacaactacaaaaatattgctgtgagatccttgaaaatgtataattgcccatttgcatgtttctttaaatttatagataaggaattactggggcaaaaagtgtgcacaatttaaatttgatgtttttgtttttgccaagctgctttttaagaaggttgtactaatgcacacttttatcttgacactaagattttaaatatgatcagaaaatgggtttctgatagtaaaactgtctacttgtaataattgtggcattagaaaagacctttgtggcttcgttcctcaaactcatttacgaattataaatctgaattccaaatatgaattaactcacacaagataaagctttaacagttagtagcagtactgtaactagagtgcatgttttctgtctccagaaataacattctttttatgccacatttttttaactgaggtgatcattctccaccctcttctttccatgtttttccatgtttgttcaaacttttcattaaatatcttgaggctctaactaaattaagggtggccattaaaattgtatgtgggattccctgaaccaactggtaatgcactaccagcatataaggtgtcctcattaaagcagttggtgattggtacatgggacctcactcatgtatgtttgcatctacttgtgagtcaaaaagttttcttaaagtataggtgggatcatgaaagacatacaattcactggagaaattgtgaaaaagtaaaagattatgaatttaggctcaaagccaatttccctctcatttaattctacatgagcaagtcaaggagtttggtagagctttatgaaatctctaaagattgaaggaaaacaatcactaaaatcgatttgataaagtgcaactaagtagtatgctagcctgttaatggattttcatcttgtcatttaagtttcagcaattgagtaccacactagaacacccacaaatgagattctgttacagagtatcttttttctactacagaacatactgtagacagttattcagtggttaacttgtggaaataatcagaagatgcttttcacttttatgactggatatattttaatatttatcatattaagagaaacttaggttacttacagctcataaacgttgctatgaacatcattcatttattcacttatttatttttatggtgttcctagaaagaatttcctggactaaaggatttatgctttaaaaatattggtagttactgccaagaattgccatccagaaacagtgtagccattcataaactcaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtatgaattaatgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattagaaactctgggggtagggttagacatttgtgttttaaacaagccctccaagtggtttcaatgcacattcaaagttgagaaccaatcactgatagagaaaaagcagcttgggtagaaacagttgattatttgcaaatttatattttaaaaagataggattcttaacagtaagctctttataattcaacaatgtgatctttactcctacccccgaaaaactaatatgattttagtgtgtggtagctggatcgaaaacataataaatactcagatatgcaaag

SEQ ID NO: 6000 - DNA, 741 bp, Homo sapiens
aaaaactcaaatccaaaaaggttctgaagatttttagtgccattggtttgtgttatagctaatgccagtattgtgcctattaataagagaccaaataaaaagcaaaaataaaacagatcatttaattataatttaatttatctaatgaagaccagcaattataaaacttcacacacacctaacttcagttgttatacaaaatcataatcatttgtacctttctaagaagaaacactgtgttcagagcttatgttatgattaatgaacagtgacagcagctaaaattcatatagccactatattttcattttgtggcaaatagctatcaacaacttactgtatgatttaattaagtggttaaaaggatctagcttcaagtttatgctctaagtaaaatgtttttcaaagatgggcagtaaacagtattttccccctgtggaaaagcagtttttcattcttccaaaaattgtaccaaggtaaagcaaagctctagatgatgcaggcatgttatgtaggcgttagcagtactgccctcactatgtgctcattggacagtagtgcaaccccaagaaaaagatggttagcagtttttgttgttgttgttgttgttgttaacgaaataaaacaaaaaacagctcattgctagtaaggaaactattttgtgaaactttcttctttttatgtgtgcatatactaagtcacaatgtaaatgtatttcttagaatgagtctcagaaaggtt

SEQ ID NO: 6001 - DNA, 1269 bp, Homo sapiens
gagtcttctccagaacatctctcgattaaactcctcggtggtctcctgggcttcgccgacttgtgggtgtggcgtgtgggggccgaacggtggcgaatggaaaagctgaggtaagcggagccacctccctcgcccaagcccggctccccgccgccgccccagcccgccctctccgcgaccccgagcccggcctctccccgaccccgagcccggcctctccccgaccccgagcccgcccctgccgtcgcccgttctaactccgtcagctcaccccgcactcgaggcaggagcaaccgcagctcctccgccaagtgccggagctgctccaaaggcgaagccagggtggggactgcggctgcaggtgcagttgcgctcgccatctcagtcgcttgccgaaggccgcaaacacaggcctccgctgccactgccggagccgcactgcgacagccgctccacttccgggccacagcgtcaagggctcgtttccgtcaacaagccgtccagccccgtcccagaggccctgccctgcctcctcccgccacgaggcccggccccgcccgaggtccagcaccacccatcccgttatcagagaccaggcctggccccgcctcctcccgccccgccctgtcccctgaggtacagcaccaaccatcccactctcagaggccaggacaggccacgccttctcttgccccttaggccaggctacacaagcaagcctcaggctcaccgtctttcttattcatcattcattcatttatttgattagttgaaaacacttccgactaaggaagcagagagcccacaatcctgtgggaaaacaggcctgggaactaatatctcaggggtagtgagggtcgggcccagatcctcaaaggggagaataaaaaagctagggtgccgtatgttgcataaagaaagtagcaggaataaacctgccagatgtacagcagtagcataagtaggtgaacaggcataattttcaagtattttctttgatggagatgagacctgaagttgtgaccaaagcaccgctgcagcaagctccaacacatgtaagccatcaaggggatgttaaaaaacgccagctggaaaagaacagaaccatagcttactcccaagtccttggaagagtttggtcttaataatgcattattagtggatcctaagactatgctgctatctgtcttggcgttagctaatttacttcaagcacagttgcttataacacaacagctgacttgtggctagttgtgtatttgcccatgt

SEQ ID NO: 6002 - DNA, 575 bp, Homo sapiens
aaatgcgaaagcgactgccttcttggtccaagcacaaatgtggatcactgaacacagtactggaagcgccatttgcagataaggatgctacattaaaggaatcgtgtgcagcatgaaaagattagaatcgagctgcacctaagaaaaaaatcccaaagttactttcaaaagtatgtgttatctgccagtcacagaggggaaaagcacctagggtgaactccaattttttaatgaggaccttgatcaggaccacaaagcctgaaacatttattttaatgcagaaacacagcccctagttacactgattgcatttgggaaaattggagggttttttcgtccttagttttttttattaaattacaggatatggttttcgattactaagtattcgaaatcctcataccagcaacagaaatgaaccacttccaaattctaagacacaaaagaccaaagagaagcaaaagcgatacaaattaatatgtgcccctctcctttctgctctaagggaatctacaaaccagtatcacatttaggagtcaaagtgttaattcttcagcattcctgacaactagaaa

SEQ ID NO: 6003 - DNA, 464 bp, Homo sapiens; identical to SEQ ID NO: 5997

SEQ ID NO: 6004 - DNA, 2506 bp, Homo sapiens
agagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaaggttcctgcatcatcatgaaatttgaagcacttttatagtagtacaaactatacttttagcttttgaaatctcgataggagaaaatatccagcagttttaggggctattttggcatattcattaaggtagactaagtttgtttttcgtttttcccacttagccaaactagttaaagtagtcaaaactagcaaataatttttaaagggcttctccttttgggtggtgtagagggtggggagttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaactgaatgtggatgagctataaatatttagtacaaagaatgtaatttgtccactctgaatagaaagtaagcattaagaactcttgaatgtcttcaagggttactttgttacgtgtaagatgtctccccttccttcatagcagtttttattcctgcttaaaaagggaactaaatatgaagtcagtagattttaaggtaattttcagaatgtttctactttcaccgtgccttaataaggaaaaaaggccattttccaagcgaatggaaacaccctttccttgttttgtgcctttaatcagcgtgtaccttcattgttcctgattgccaaatccacgaacttcttgagctctcaatttttcttgactttcctatggcattttaaatactgttcatacttggaattacttttctttgactgccttcatacattcatatattctgcctgggcaatttcatttgggcctattatgttccaatacctctccaattttcacctccatcttagctctgccagcttcagtgccacaggtaggcaatgtaaaagtttactggggaccacaggctttctgagctcaataaaaatactaagcttggtacttgttttttaagaattttcttcccccatcccctcacaaagattatttgagtaaattacaccccaacctcc

SEQ ID NO: 6005 - DNA, 831 bp, Homo sapiens
taactttctatggaatgaaaaagtctagcaatgatacctattccaaagcagtgcagttggcgctacctttacacagaatacacaatctcttaaaaatacacttatctcaagctgaagcacacaaacttctaaagccagaaattaaaccgagaaatgactgcatgagataagtagttccaaatgttccttatgctttaaagtgagaggatcatcaaagtgtcagggaattcagtattctgtgagacagaccaatgaaatttgagaaacactttaactttgaaagtgcaaacacgtaattcaggaagatgcacagtttcattaaaagcttaaattaacagagactcaagaaataagtgaagcctgtaaatggtgaaagcaaaagagactgaggagctgatacccaaacttgtgaaggagaagctgatgaacagcttcagacttaactgctattatgatttactaaatcattcttttatatctcctgtggttaaaaaatgaaaaccaacctgggctgaaaacagaagactgaatgccaaaatgtttggaatcccacttcattcaaatagtgaccactggggttatgaagaaagagaagttattggtttccacagaagcagagtcagcaggggtcatggtagttaagtagtaccttcatcttgtctccagaatttagttcttgattcataagtaggaggttatgaaggtagaaagttgtagatttttgaatatatgaaacaacaaggttactaaacagtttaaattctccaagcctaggagaatttctagttcctcgtcgtccactctttattaaaaatgaaaagtgaatttacc

SEQ ID NO: 6006 - DNA, 1702 bp, Homo sapiens
tgttgctgtcgctttagtgactcttctctgccacacgcttcctgtgcctttgccttcctctggtgtgattcggcaggaagaccaaagaggggaaaaagaagtcacgggcacccctttgggacctacaatcagagaggaaggttactttccttcagagctttaatcacctgaaggccctggcggctgccactgtcactgtcactgcctctgtcaccaccactgctgccacaggattgcctgtgggctagaacatgaaagtacaaagaaaagaagaaagaaaaactggggattcccttaactatcgctgagggctcagaagtggaaaaatatgaagatccattgctgatgggaatcctgccctaagcaaacggtgtgtactaaagggagcacattgttgagaaggaccggttgcaaatttccaaaaaggagagtaaaataattaatgagtcaaggtctcaggagagacagaaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataa

SEQ ID NO: 6007 - DNA, 21798 bp, Homo sapiens
ctctgtggtccttccgccaaaacatctgggctcctccacctccccgagcccaaatggccatgcaggtcgaacaccagctctgaagtgggcagggcccccagggaggacagccacgggagctcaggcagcgtccccgccggcacctgcctctttgtgcagcggcagtcagggccctcggcaatgagctgaactcgcagtgcggttacgagggcaaatatgctccttgagggccggcgaaactcagcagcccgaggaaggctactgatgtgcatttcatagccggctgcgaatttaggaaaacagactttgcttctcgtcactcagcctacgtgaccaggttcagacacagtctgcagccgcccgcctcgcacccccactctgcagtgcggtatgtggggagctcagggcacagcaggccaggcctccccgtggacgtccaggaaccagaaccaaactgcccagggccccagaggggaagatgtctcagcagacggacagccgaggctcacatggcaagctctggcagcctgtcggtcccaggagagagggggaggtgagtgaactgagggagggccaggtgacaggtcacaaacaatgaaacttcctctgggcacagcagaggttggttttgttttgggggtgatgtggcgcggcactgttgcttggggaatatttggtttttgtcttattttgtgggggtcgtggagcagtgctgctgttctaaggatgtttggtgtctgtcgtattttgtgggggttgtggagcagtgctgtttttctgggagttatttggcttctgtcttattttgtggggttgtagagcggcgctattattctggaaatgtttggtttctgtcttattttgtgggggtcgtggagcagtgctgctgttctaaggatgtttggtgtctgtcgtattttgtgggggttgtggagcagcgctgtttttctgggagtatttggcttctgtcttattttgtggggttgtagagcggcgctattattctggaaatgtttggtttctgtcttattttgtgggggtcgtggagcagtgctgctgttctaaggatgtttggtgtctgtcgtattttgtgggggttgtggagcagcgctgtttttctgggagtatttggcttctgtcttattttgtggggttgtagagcggcgctattattctggaaatgtttggtttctgtcttattttgcttcgcccagcctcggcctgctgtgtttatggttaaaataactctgtgggcaaacccgagtctccagctctcatccgctgtcccctgggctccctcacttcctttcatccacagcgcccactgcaagtgatattcttataatacactgagcaactattttagtaacacagaaactttctggggatatgacccactttaaacagttatctagggagagggaagaaagtgatttcgctccaggcctgggcatctcctttcacccacatttcattttgcttaatcccacaaaagccgcttaaccgcacctgccatgttttcccagacagccttgcaaacatgcgagggtggttactggagccttctcggacccgcgtgattccaccaccgtgagatgcaggaactgtctagatttgcagacagagcttgtccttgacccccaaagctccagccctgccctgtgggcgaggagctttggtgaactcagctcacctcagtgctgcaaggttatggcaccccacactcatgcgcctcccaggtgcccagcttcttcactggaggaggggacggtgaccaggctagggcccttggtacgggctgaggagctctttcctcactttccctggagcccgtgttctgcaagatcaggtcgactgaagcacatcagcttctgtcccaggcccctctgcggatgagcaagagctgctgaccaatgggagtgacagctcagcacaccagccagcggcccagcggaaacacgttctgcaggctcatcttgggaaaacttctactcacatacaaatatgcattagagtcagggtctcaccctgtcacccaggctgcagtgcagtggcaccatcatggcgcactgcagcctcgaacccctggcctcagcctcctgagcagctgggactctgaccccatgtgcaccaccacacctggctactctttccttttttgttgttgtttttttattttttgtagagatggggtctcactatgttacccaggctggtctcaaacttttggcctcaagaaatcctcctgctgtggcctccttagtagctgggatcacaggcatgagccaccgtgcctggctaattgttatttttattttttgtagagatgggggtctcactatgttgcctaggttggtcttgaactcctgggctcgagcaatcctcccacctcagcctcccaaaatgttgggattacaagcatgagccactgtgcctggcctgcaaagttatattttagttaagctttttcaacctcagaaaataactggaggcgcccaacttccactgagcacctaggctgggaaataggcagcagaccagctctgagctttaagatgtctgggatagggcaggagctgagaggcatttgggactaaattttttttttttttaggtggagtcttgctctgtcgcccaggctggagtgcagcagcgcgatctcagctcactgcaacctccgcctcctgggttcaagcgattctcctgcctcagcctcccaagtagctgggattacaagcgcacgccaccacacccggctaatttttgtatttttagtagagatgaggtttcaccatgttagccaggatagtcttgatctcctaaccttgtgatccacccaccttggcctcccaaagtgctgagattacaggcgtgagccaccgcgcccggcctgggactgattcatttggggtccagcccactcccttaaggcaggaggctgcaaagttgctggggcctgcattccaggccacaccgctggccagtggtggaagctgagccacctctctcactttcctgggcctccacttcctcatgggtaaaagtggaaggaaaaatacctccctctgcaaaagggttgagcgagatgatgcaggtgaagggtgtggtcctcaatgagcccttaacacatgccagccatcatattccagccctgactatgttggtcatcagcagagctgtggccttccagcttcatcctgacatgcggaggccgcctttcagaaactctcccaagcaccttcccccagcatctgggccctgggcatggccactgctcaaagtcccagacgaggccatccatcaaagctgtacttggcaacagcaagtaagagaaggttgtcagggcactgcatggccccaggcccccctcctctgtaagtggaccatcagagccaaacgtcagggctgagcaggcctggagaccagcgaccccagcctcctgcaaccctgccaggccaggaactaacagcagttccagaattgcataggatttcctcagtgccttctaggcactgggcctgctctacatcccaggatactatggggaacatgtgggactctgtccctactctcacatggagcctggcagttagacatgacacaacccacaaacccaccagccaaccaaccaacatccagattccagaacgacaggggatggggacagggtgggtggagggcaggaaaggccctccaatgaagtgaggcttgaatagagagagacagcaagtcctgactctctctgggagaagactgttctaggcaaagagcatgccaagggctcaactggaagtcatcatgcccagactcaagcaaacaggacacgtgtatctagttcactcagaatgggagctagaaggggctttgacatcagctagttcattaaggtcctcacattgtcaccatcgtcattactattgccatcataatcaccatcatcactatcatcaccaccaccacatccaccatcgtcaccaccaccagcaccagcaccaccactaccatcactaccaccactgtcaccatcaccattaccatccaccaccaccaccatcaccgctaccaccattaccaccatcagaagcaccatcaccaccatcaccaccaccaccactgccaacatcaccatcaacatcaccaccactaccatcaccaccaccaccaccaccactgccatcatcaccatcaacatcaccaccactaccatcaccaccaccatcaccaccacttccattacagccatcagaatcaccatcatcatcaccatcactaccaccatcaccaacaccaccaccatcacaatcaccaccacatcaccatcatcaccaacatcaccactaccaccactaccatcaccaccaccaccatcaccatcgcagccaccatcatcaccatcaccaccaccgcccccactactcataagtaagggtgatgataaaagcaccagccacgttagcagatccctggttatagttccagcatatgtgctcaattctttacagtcaggaccccactgtattctggaaacaactccaagagacagggactatcgtgtctccatcttacagacaaggtgagggaggtatggaaaggcaggagtacatacatgtctctaagggggagggcacttggcctggtcttggccatcccttgccagctccaggatgctcctgtttgtggctgcaggagcctccacacggccataactaggtggcaccgtgtccatttccccctcctcctctcatgccatggtgagacgcacactgagagcaggacactgggggcagcccttcctgctgcccgctgctgggccattaggccctgctgacacctagcagggcggaaggcctggcagtggagagaagggagcagatgttcccccaacactgacctcgcaccttggaaagaagcaagatgggaggagctgagagggaggacggtgctgagcatggctgaccccgagggctgggctgccgaggtcctgcagaagctataataaggctgtgcaccaacaagctcacagagcaaaccacccccaaaccagcctggaccccgtgtgcacatgcccccaggcctccaagccggatcctgcgggccaacctgcccctcccccagccgccaaggcttccctcccagcctctgaccctgcgccctgtggggcccagccttcctaaggaccgcagagggtcctgggtcagctgtgggcacaggcccggatgcctgcagcattgcaggggccacgggatacagcgctccctcaccggtgaggcattgctgggcctccccaggtgggacatgtactcatggtgcctgtggacctgcaggaggtcccccagaggcttcccgcccccaggcccaccggagcccccatacttattgctgatgtcctcgatcttctgctcgggccgctgcttttgctggaactgtcggttctggaggtagttctccttcaggtagatctcccaggatagcagggccgcctcctcgttcttctccagcttgttctctgtcagggtgggcggacagaccaggggacctggaatcctcaggaggtgggccctgaagccctgacccaccgggggggccccgtgggagggggccagtcctgagtggcaggaagagcccatcgcacacctgcccccaagggggcctctgggctcagcccccaccacttgctcaaggccagcagaaggccagcagcctgagtgacctgcacgcctgctgagcgtccagggttctgggcagagctgccatgccatctccaccccctctgcacccgggtggccaggacattcaggagaggcactggggctggcatactgagctgcttgtgcctcttggccggagtcttcaggaccaccctcttgatgaagagctgcaggtggctgaggaggatgaaggggggcggcgcggcggggcggccgtggtactcctcgatcaggtcatggcgctggaacttccaaatctggtccgtgtgctcctgcacctgctggaaggtgtagctgtcagggaggagaaagcaacacctcgaggtcagggtgtttacccagaacagacccctctcaccgcctgcgtgcccactgtgatgccacagagagcagagccacgcccacatgcccactgtgatgccacagagagcagagccacacccacatgcccactgtgatgtcacagagagcagagccacgcccacgtgcccactgtgatgccacagagagcagagccacgcccacgtgcccactgtgatgccacagagagcagagccacgcccacgtgcccactgtgatgccagagagcagagccacgcccacgtgcccactgtgatgccacagagagcagagccacgcccacgtgcccactgtgatgccagagagcagagccatgcccacgtgcccactatgatgccacagagagcagagccacgcccacgtgcccactgtgatgccagagagcagagccacgcccacgtgcacactgtgatgccagagagcagagccacgcccacgtgcccactgtgatgccacagagagcagagccacgcccacgtgcccactgtgatgccagagagcagagccacgcccacgtgcccactgtgatgccagagagcagagccacgcccttgtgcccactgtgatgccagagagcagagccacgcccacatgcacactgtgatgccacagagagcagagccacgcccttgtgcccactgtgatgccagagagcagagccacgcccacgtgcccactgtgatgccacagatagcagagccacgcccacgtgcccactgtgatgccagagagcagagccatgcccacatgcccactgtgatgccacagagagcagagccatgcccacgtgcccactgtgatgccacagagagcagagccatgcccacgtgcccactgtgatgccagagagcagagccatgcccacgtgcacactgtgatgccacagagagcagagccacgcccacgtgcccactgtgatgccagagagcagagccacgcccacgtgcacactgtgatgccacagagagcagagccacacccacgtgcccactgtgatgccacagagagcagagccatgcccacgtgcccactgtgatgccagagagcagagccatgcccacgtgcccactgtgatgccacagagagcagagccatgcccacgtgcccactgtgatgccacagagagcagagccacgccacacgggaggccagctccaggcacagaactcagcccacagacctcacaattccaggcttcctgggaaccaaagcaagaaaaaaggagaagcacacagactttcgatattataagcctcactggctaataacacgaagtgggtgtttatcaggagacagacactgtctggcactgaactctaggacctgatctgtggattctgacgagcacaagagccagaccctccaggggtgcatgtggaaggggcagggctgcaggggcctccttggtgtgtctcagggtgacaggcacagagccctccgcagtgggagccggaagtgtgggtgccatacttgctgcagggacagtgtcctgccaccagccccttggcctcgagatgacagtcctggcccatgctcgggttctctcaatgttcagaacccacgttctgaaaggtggcaacctcagcaacttagccaatgaaacaagaagagaaacggttggttcctaacaaaaccaggaacacaaggattttcagagtcctgggtagcacagggtctgtctgcagatgctgggaagggctctgagggcctgggaggctttctgaattatgggggcaacgtggggagactgggctttctgtggaccatgacagctccgcagccgtgctgggctcctcagctccactgtcagggctaggaattggccacagaacccccagagccaaccctggggcccactaggaccccaaacacctgtgttttcattctgcgtggcctcctggttccctggagttcttttttatgctgcctctggtgtgaggtcctcagcatttaatttgttctaagtttaaaagctgcaagagcaaaacagaacccccaaagcctggggcccacagctgctgcggctgatcagagatacgaccccagaggaccacgtccaccaggggccggatggacagccacctattttgtactccttgtttcaaaagcaacaatagcaaataacattccaaaagttctatgataagacttcaagacactaggatttaaagaaaatcctagacattttcaaagagaagaaacagctactgcatgggtctcctgatgctgctgtagtgaaccgccacggccttggcagcttaaagcaatcagactcttctctcagtcctggaggtcaggagtctcactgggctaaaaccaaggttcggcagggctgtgctcctcccgtaggtcgggagcctccatgccttgcctttcctgccttccagaggctgcctgcattcctgggctgaggctctcccctcccgccgacgctcactgccaccgtcacattccttctccgcctccctcttccacggcccctcatgatgatgtcgggcccatgcagataaccccagataatttcccacctcaggatcctccacttaaccccaccctcccagtcccttttgccacatagggccccatagccacagggttcgagtgtggacctccctggggctgttattcaaactgccacagatgccacaaacaccaggcccagaggaggtggacacgtgtgtgcaaatccacaaaaccagcaaagcacgtgaagacgtgcagatgaggaagaccccaatggcacgggagggcagacacagagccgtccacagatggatcggagctctggggaaggcaccgcagagccagcgccgtctgaggcacacggtgggggcagcaggaacacgtctagggctggggaaccggccccaaagagctaaagaacccagcaactaaccgaaatgctcacacttacagatggcagacgggaaaagaagccacctgctgggatgctgagactcgcttgcaggagcttttggaactggctgaggtcacagctggaaccactgtggccagctggagtctgcacagcccgagtttccaccccagggtcccagtaactccgcccaaatgtgcacacgagacctatgaggagacataactttccagaacccccttttcttccaccagccacttactcatccaagaacccacccccgaaccttccctaatagaaacactgcattaaagccagcgcggggagacagacgtgaactgcgcccctgtctccttgtgggttggcctagaataaaagcttttcttttctcaaaaacctggtgtcatagtattggcctcctgcacatcgggcagcgagcccttttgctcagtaacagggagacacaggcagagcccttggggtgacaaggggacagccctgagcagcagcggccccagcacgctccccgggtagagcagtgagcccatgaataatgctgcgcctgcgcagaaggaacgaggctgacaccaacatccctgccctgcgggaggaggctgcctccgcagcagcaccgtgagcagggcccttgtggatccacagcaccgcgggtccccagcagccacaaggacagacccacgccagctcaagagacagactcacgccagctcaagagacgcagcagtgaccacagagagtggctgtgcacactccaccaggatatgagtgacgcgcctctgtgcaccagcccatcatccacactgtccacgagaccctggagacagcatggccactgcggcccaggaacgccgcccacccacccacctgcacgccagccccacccaggcgctcacttgaacatggcgatgaggagcttggcaggagggggccctcgaggcctccagtcactgccaggtcccccgcaggcctgatgctgctcatttgggtgacctcagctgtcacctctgggccagaagtccagaaagaggcatctgtctccagccagatgcaggtaggaggccccgggggcagagctgcacccaggctggcccgtgcctccgcccagggtgtgccacccaccagggcactgccagggtcccagccagggccagcaccaggtcccaagcctggggagttcaatttggtggaaataatttaaaaggaaaggccaggagcagtggctcatgcctgtaatcccagcactttgggaggccaaggcgggcggatcacctgaggtcaggagtttgagaccagcctggtcaacatggtgaaaccttgtctctactaaaaatacaaaaattagccaggcatggtggcgggcgcctataatcccagctactcgggaggctgaggcaggaaaatcacttgaatccgggagggaggtggaggttgcagtgagccgaggttgcctcattgcactccagcctgggcaacaagagcaaatgtctgtctcaaaaattaaaaaaaaaaaaaaaaaaaaagaattgaaaaggaaaaaaataacaactatcccaaagagaagggagacgtggagatgtggaaaagggaagatgttgcagaggcaatgtatcgacaagtgaaacgggtgattgtgaagaaaaatagcgtcctgcgtgcatagaaagtaagggctattgaatatggaaacagcttctaccttaaacaaatctctaaggaaacatagtaagttgttaacagtagttaactccgggaggtgaaattatgaataacattctttccttatacttatcttgaattttaaaattgttcaacaatgagcaatgcattattgggtaatcaaacctattttgaatgtgttactaattttctaagatagaaacgcactctgatggctataaattcctatattaataaagaagagctgaaattattaacgtaacttcccactgtagtaaactagaaaaagaagagcaaaccaccctttcacaataaaaacactcaagaagttaggaatcaaagagaacctctttgattgaaaggacatttacaaaaaccctgcagctaacatcatacccagtgggaaagactggatgctttccctgagacaagccaaaagcaagcagaaggaaggaaagaatgaagattagaatataaatgagatcgagaaatcaaaaacaatgaatgtcaacaaaccaaactcagttcttgaaaaagagcaacaaaaataattaccaccttgtagctaagactgatcaaggaaaaaaagagagaaggctcaaattgctaaaatcagaaatgaaagagaggatattactactaatcttacaaaaagaaaaagaactcaaaggaaatcctagagaaaattgtatgctaaaaaaattagatgatctagatgaatggacaaattcctagaaagacacaaactaccaaaggtgactggagaagaaatagaaaatataaatagacctataacacataaagagattgaattagtaagttaaaaacatcacacaaagaaaagtccacactcagaggagttcactggtgaattctaccaaatgttcacggaagaattaaaaccactcttttacaaactcttccaaaatataagaggaggaactacttcctaagccattttatgaggccagtattatcctggtgccaaaactaggcaaacatattacaagaaaagaaaaccacagaccaataaccttcatgaatataggtgcaaaaatcatcaaaaaacagctagcaaagtgaatccagcaccatgtaaaagagattattcaccaagaccaagtgggacgtgtcccaggaacataaagttggtttaacattcgaaggtcaattgatggaatgcaccatattaatagtaaaaggatcaaagaccatctgaacatttgaataagtgcaggagaagcagctgacaaagtctaccactccttcacaataaaaacactcaagaaactaggaatagaagggaacttcttcaacctgataaaggacatttataaaagccccacagctaacatcacacttaatggtgaaaggcttgttccctaagatcagtggactcgtcttaagatcaggagcaaagcaaggatgtcccccattgtcccttctgttcaacattgtactggaggttctagccagggcacttaggcaagaagaagaaataaaaggcaaccagtttggaaaggaacaagtaaaactctctttttgcagatgacatggtctcgtatatgacaaatccactaaaaaactattaaaagtaataaagaagtttagcaaggtttcagagttcaagatcaatctacaaaagacaatgtatgtctacataccagtcattaacaatttgaaatgaaatcaataggacaattctatttataatagcttggacaataataaaatatttaggaataaatttaacagaagaagcattaagacttattactggaaactataaaacattattgagagaaattaaagaattaaataagcaaaaagacatcccatgttcacaatcaaaatcacagatgccctttttggagaaattgatgagctgatccaaaaattcttgtgaagccaagggacccagaggccaaagcaatcctggaaaagaacaaattaggactcacacttccgaatttcaaaacttactacaaggctacgctcaccaagacagcacggtcaaaacttactacaaggctacgccaaccaagacagtgcggtcaaaacttactacaaggctacgctcaccaagacagtgtggtcaaaacttactataaggctacgctcaccaagacagtgaggtcaaaacttactacaaggctacgccaaccaagacagtgcagtcaaaacttactacaagactacgctcaccaagacagtgcggtcaaaacttactacaaggctacgctcaccaagacagtgcggtcaaaacttactacaaggctacgctcaccaagacagtgtggtcaaaacttactacaaggctacgctcaacaagacagtgtggtcaaaacttactacaaggctacgctcaccaagacagtgtggtcaaaacttactataaggctacgctcaccaagacagtgaggtcaaaacttactacaaggctacgccaaccaagacagtgcggtcaaaacttactacaaggctacgccaaccaagacagcacaatcaaaacttactacaaggctacgccaagacagtgcggtcaaaacttactacaagtctacgccaagacagtgcggtcaaaacttactacaaggctacgctcaccaagacagtgcggtcaaaacttactacaaggctatgccaaccaagagagtgcagtcaaaacttactacaaggctacaccaagacagtgtggtcaaaacttactacaaggctacaccaaccaagacagtgtggtcaaaacttactacaaggctacgccaagacagtgcagtcaaaacttactacaaggctacgccaagacagtgcagtcaaaactcactacaaggctacgccaaccaagacagtgcggtcaaaacttactacaaggctatgccaaccaagacagcgcgatcaaaacttactacaaggctacgctcaccaagacagtgcggtcaaaacttactacaaggctacgctcaccaagacagtgtggtcaaaacttactacaaggctacgctcaccaagacagcgcgatcaaaacttactacaaggctacgccaaccaagacagtgaggtcaaaacttactacaaggctacgccaaccaagagagtgaggtcaaaacttactacaaggctacgccaaccaagacagcacgatcaaaacttactacaaggctacgccaagacagtgcggtcaaaacttactacaagtctacgccaagacagtgtggtcaaaacttactacaaggctacgctcaccaagacagtgcggtcaaaacttactacaaggctatgccaaccaagagagtgcagtcaaaacttactacaaggctacaccaagacagtgtggtcaaaacttactacaagtctacgccaaccaagacagtgtggtcaaaactcactacaaggctacaccaagacagtgcagtcaaaacttactacaaggctacgccaagacagtgcagtcaaaactcactacaaggctacgccaaccaagacagtgcggtcaaaacttactacaaggctatgccaaccaagacagcacgatcaaaacttactacaaggctacgccaaccaagacagtgcggtcaaaacttactacaaggctatgctcaccaagacagtgtggttctggcacaaggacagacatcagtggagtcaaactgagactctagaaataagcccttatgttaatggtccactgattttcaacaaggatgccaagatgcttcactggggaaacaacagtcttgtcaacaaatagtgctgggacaacaggagagccacaacgaagactgacccttaccgcacaccagggcaaacaaaaagcgaaagctataaaacacttagtagaacacaggcataaatcacggcaatggttttcgctaggacaccaaaagcacaatgatcaaagagattgataagttgaacatcatcaaaatttcaaaagctcgtgcatcaaatgacaccataaagaaaataacaagtcagtgcacagattgacaaaaaaaattcaaatcatacctttggtaagagactggcatccttacgtaaagaactcttacgactcaataatataaaagacaactcaataatataaaagacaactcaattgaaaaatgggcaaagatggctgggggcagtggcttatgcctgtaatgccagcactttgggaggccaaggcgggtggatcacgaggtcaggagatcgagaccagcctggccaacatggtgaaactctgtatctactaaaaatacaaaaattagccaggcgtggtggcgtgcgcctgtagtcccagctactcgggaggctgaggcaggagaatcacttgagcccgggaggcagaggttgcagtgagctgagatcgcaccactgcattccagcctgggtgacagagcgagaccctgtcggaaaaaaaaaaaaaaaaaaaaagggcaaaggagagggagagacatttcttgaaagaagacttacagacgacgaggttagcagaggaggagatgctcagcatggcgggtccttagagaaatgcccgtcaaagcgacaaggagagccacttctcacccaccgggatgcgagctttgtttttttaatggacaataacaaatgttgacaagaaggtagagaaattggaatcctgggactgggcaggcaggaatgtggaatgcggccggttctttggaaaacagcccagcacgtccacaaaaacttaaacatggagttcccatatgagccagccgtgcattcctaggtgtctaagagaaataaaaacatacccacacaaaaccctgtaaataactgttcatgctacgttattcacagcatgtgaaaagtggaaacggccctgcgcggtagctcacacctgtcatcccagcactttgggaggccgaggcgggtggatcacctgaggtcaggagttcaagaccagcctgtccaacatggtgaaaccccatctctacaaaaaaatacaaaaattagccaagcgtggtagcaggtgcctgtaatcccagctactcgggaggctgaggcaggagaattgcttgaacccaggaggtggaggtcgcagtgagccaagattgtgccactgcactttggcctgactccctctcgggaaaaagaaaacagagcgagactccctctaggggaaaaaaaaaattaaatattaattaatttaaaattttttaattaaaaaattaaatattaattttttttaaaaaaaaggaaaagtggaaacaacccatatgtccaccaactgatgaatggatgaacaaaatgtggtgtgtccacacagcggggtcctcttcagccataaacgggaagtaaatactgatacacggtgacaaaccttgaaaacgggacatcaagtgaaagaagtcagacaccaaagactgcctattacatcatccagtttctatgaaacgcccagaaaaggcagctcacaagtagcttcgtgggtggctgtggctgaggggaggggaacgggagtgactgtgagtatgcagggtcttttcagggtgatgcagatgttataaagttagattctgtaaagatactgaaaaccactgacaggtgcactttatccaggtgaaatttctctcaatgaagctgttaaaaaaaaaaaaaaaaaaaaaaaaaaccttctatatgaaaagtgttctctctggcaggcatggtggctcacgcctgtaatctcagcactttgggaggccaagggggtggatcacttgagctcaagagttcgatactagcctgggccacatgctgaaacccccatctctacaaaaaatacaaaaattagccgggtgtgttggcgtgcacatgcagtcccagctactcagcagacgggtgggaggaggacttgagcgcaggaggtggacgtgccactgcactccagcctgggtgacagagcaaaaccctgtcaaaaaatggaaggaaggaagggaggaagggaggaatgaattatttccatcaagagaagaaggaagttatttctgattgaggtgagagggaaaggggatacagggtgacattccatttcagggggctgtcagctgatgccccaggtgccctcggcccactctgacctctgcgtggcaccactcacccccaccaggcccccctcctccctcccctggtggggccccttctacttcctgccacaggagctggggaatgaatgcccccagggaggacaccggccaggtgggaaccgcaggaccccctgatggagccggcctcactcccactcatgcggcccctttccagcctctctcctgcttcccggcagcaccacccgagctcccatggcgcccggctcctaccgtcgatgtagcccgggatctgcccgaagatggtgaggtaggagtggtagacggcccctcggaacagccagtccacccggcgctcgttgtggatgaggatggcctgcttggccaccccgaaggacaccacccacacagccagcaggaagaggaagaagaagacgtccttcatctgcaggacagagagtgtgtgggctacactctcctggcccccgatgctcactgggcccagaggcaggcccagcagcggtggagacagcactgccactcacagcacagacacggcatgcaggaggctcccaggagcagtcctggggctgcccccacaccctcgtggactgccgacatctttgtgctagcaccacaaagtgcaagaggggtcagacataaccgtgacccaaggaggaaagctcctagagctgaatcagaggccaggaatgagtgcggtcagacataaccgtgaccaaggaggaaagctcctagagctgaatcagaggccaggaatgagtggggatcagaggggagaatgagggaaggcttcctggaagaggtgacgtacaggcaaagatacgagaagggcattcttgggagcccaaggggcaaagcagggacggggaacctacaggtgtgtttaagccccagtccgagccactggcaaggggcctgccctccccgaggcccaccctgggctgcaggccgcgatggagccggtgcccccgcccccttaccatccgcttcacaatgatgatcttgggccccagcgtcttactgatggtaaaaatgtgcatgagccggaggcagaacaggatgaagtccagagagaggatgacgcgcccggggtacagcgtcgccgggatgagcctggccgccgggcagaagcacacacatctcagccacctgctcacagcagcccccagagctgtcccccgtcgcccctccacctgtcctagcccaggtgggccctggaggcaaagggctctggtgggccctgcatcccaggtgttcaaagctggcatgagattgaggaatagagcctcccacttttcttcagacgcccagccccacagggcagcctggcatgggggcacctggagagccagcagttagccagggccctattgcctccgagaaagggggccgcggcctcgcagagacacgagagcatcacaggcagtgcagtgagcccacagtagggaggcagagggagaaagcggcagccgcgtgtccgtggagctgggacaattccagaggttgccatctatggccccttgcacatggacaatctcagctctgccaggagctctcatgccccttctgtgctccctcaacaatcccaagggtaggtggggcgctgttgcctggacacccattggacagatgacaatccagggttcacagacgagctgagcctcacccggtgtggctggttctgggcccggcctgtgctcatcccctgcagggctggctgcctcagacgggcccgccatcggggtgaggccactcacctgcaggtcagccctgccacgaagagcaagattgcgccgacgtccagcttattccagaagtcactgaagtacaaggctgccttcttcatcagcccgcactcgtcagggtcatagaagagctactgggaagaggggcggtaggaaggcagacaggttgtcactcttactatcctcactgtcactgtcacatcactatccactatcatcatcacagtcactgtcactatcatcactatcactgtcactatcatcactacccttgctgtcaccatcactgtcatatcactatccactatcatcacagtcactgtcactatcatcactatcactgtcactatcatcactatccttgctgtcaccatcactgtcatatcactatccactatcatcacagtcactgtcactatcatcactatcactgtcactatcatcactacccttgctgtcaccatcactgtcatatcactatccactatcatcacagtcactgtcactatcatcactatcactgtcactatcatcactatccttgctgtcaccatcgctgtcatatcactatccactatcatcatcacaatcacagtcactgtcactatcatcactatcaccgtcactatcatcactgtcactatcatcactatcactatcatcactatcatcacggtcagcaaatccgaacattggttctgatctgaagagagctgggtcagtgagggagatgggaacaggacgtggaggaacaatgcagaatagcgctggcagcagctacctcggccccctgctcactcagcacctgtgtgtgcatatatgtgtatgtacatatattctgcatgtatgtgtgtatacgtgtgaatatgtatgtgtgcacatatgtgtgtgtatgtatgtgtgcattctgtatgtgtctgcatgtatttgtatgtgtatgcatgtgtgtatatgtgtatgtgcatgtatgtgtgcatgtatatgtgtatgcacatacatttgcatgtattgtgtatgtatgcatgtttgtgtgtgtgcatgtgtatgtgtatctgtgtgtctctgtgtatatgtgtatttgcatgtttttgtgtgtgcatgtgtatatatgtgtatgtgtctgtatgtgtgtgttcatatgtgtatgttcattcatgtgtgcatatgtatatatgtgtgtgtatgtgtgtacatgtttgttcatgtgcatatgtatgtatatgtgtatatgtgcttgggtgatgtgtatatttgtgtatgtgcatgtgtgtatgtgtatgtgtgtatgcatgtgtatgtgcatgtgtgtatgtatgtgtgcatatgtgtatgtgtatattgtgtacatgtgtatgtgtgtatgcatgtgtgtgctgtatatgtatgtgcatgtgtatgtatgtgtatatttgtgtgtatgcacacgtgtaatgtgtgtatgcatgtgtgtgcatgtgtatacatgtgtttatctgtgtatatttgtatgtgtgcatgcatgtatatgtgtatgcatgtgtgtgcatctctatatgcatgtatgtgtgtccatgcatatgtgtgtatgcatgtgtatatgtgtgcatgtatgtgtatgcatgtgtgtatgcatgtgtgtgcatgtgtgcatgtgtgtatacatatgcatgaatgtgtgtgcctatgtgtgtactgtgtgcatgtgtgtgcatgtatgtgtgtacatatgcatgtatgtatgtgtgtgtgcctatgtgtgtgtgcatttgtgtgcatgtgtacatgtgtgtgcatgtacctgtatgtgtatgcatgtgtgtgcatgtgtgtgtgtgttggagcagcgccctcaatgtcaggcgccagctgccttcccacaaggatctttgttctgtcaggggccacactgtttctttagcaggccaagagtgcaggacctggcaggggctgtgggagcccccatttggcctacttggcaggagtccccacaccctccctagccccaggccccaggacccagcagctggacaggtggggcaggtgaccagcaggaccaaccagggccctccctggatcacagacagatgcagggagaaggaagtgccccctctgctctcaggctgctgcccatggggctggggctgggggtgcatggaggcctctggccccttgtagagagggtctggtggcagaagccctgtggcaagaggagagccaaggagagcccagcagagccagggccacagcacagctcccaggccccgccaagtcctggacctgatcttccttcctggggacgccggtgcctcccccagggccccagtaggcagtggtatttacacagtgcacactgctttctaactggggtaactgggggcctggtggtccaccaaggttagagagcagaggtaagtctaagccaggaccactgccccgtgggctgaccccaccccctcaccactgccctgagggttccaaggacctagttcccattcaccggctgccagcaggtgcaggcaccgtgggggcacagtggagaccccacacagtaagggattcgccccacctggggggcagcttggcctcgcccagctccagggagatagcctctgagcccttggaatgtccgcctgatgagggtgtctttgttcctggggcctgggccatgccaggtggtcccacagtgtgatttggggtggggccccgggcagttttcagtttgacctttggagggctggagactgaggtcaaccatgtggtgtcagcctcgcctctgtgactgacctccagtagacaccaaggcccgcgagcctctctggggacgtgcctccatgcatgaggccacacatcatcaccgggaggatggagtgccacccacacctccacagggagggactggccggatgccctgggctcagagctgtcctggatgcagctgcgtccctccccctggctggtttagtctgtagactgttgcttaataaaccataagtgagcattgccactccccagcgtctgtgggtccttctggctcgttattgaacgtgagaggggtcttagggaccccacaccttgcactgctcttcctgggggaagggacatactcatagtccacaaggtcagggcatccaccttgagctgatcagccggtctccaggagggaaggatgcctgggccgagggaaagcagggaagcaggcgcagggggcatgaggagggaggggcttggagggcagcgccccagccacccattttggggaggaaacaccggctctgctcagcttgcagggagctgggcaggctagatggggtgggctctaagccatgggtcccctatgagaatgcagccaagtgggtggccccgggctggggcgtggaaaagcg

SEQ ID NO: 6008 - DNA, 2054 bp, Homo sapiens
aaattacagaattgttttgtgttgtcaaaaccagcaggctacatataacactactggtctgtgacccgggttcagcaggcttgtgtgccaatacacttttttttttttttttttttttgcctatatatttttagaacactccctcccattttcccctcattttcaacagggcagtcggatattggaggaattgtaatgaagacttacttatacatatttcttgaattctaaagacttatatgtatttcttgaattctaattgtgtgtgtattaaagggattgaagttgtagtcacagagaatacttagataaaagcaaaatatcttgatcttatggtataggtagaaacagtcattcagatttagctgggggagataaaccataatatattatggttagaatggtgcattcccttgaaaaaacattccaaatcgcttggcatctgctttttgatgtaattcttttgaaatacttttgagcctgctgtgtaatataatggccaagaccttgaattttagagactaattgatctatcctggaatcctaggttcacttcttaactaactctaagcctcaattttctggtcaattaaaaaatatgaaagaatgataacagaacctatttcagaaaggttaaatgaggtaattatcaagtgtttagtacaatgcctggacccatttcaagccctcaaaagttagttgttaactaccttcttttgtttctttgggagaatttagaatttattgattgccattgaagattttttaggattcagtgacagccatgccttttccaagtaaaatatagcaatatagagcttatcctgctagagcagatgacagaaccaaaggtggattggattaaaaggaaagcaaacatgggggaataatggtaagaaaacatataaacaatagaataaaattaaagaaaccaaaggtaaaaattagatgaagatgtattttgatttgcttattacaaatgccccttgatatttagtgtcatttaaatatataagtaaattgtaagtacttcattatgtctggtatcattacagaatggaaacactaatgcagatgtgttacttccatatttcctcagtgaagttgtgtaactttaaagggaagaggtatttggtatacacaaacttagatggcaattctattgtagtaaatattcaaaaggaagattatataagtttacacatgaaatatgaaagctccaacataatgctgttgcatgctaatattaaagctactatccccaacaaatatattgtttgctattactactttgccagattaagtgacttggtgtccgctggaaagcagccagtgctgagagtacaattggtacttgtatctcagctattttctagtttgctcgtgtttgtatgccttcctagagtcatttgtgcttctttctgaacttgttgattccagtcgtacttgttttgttatgaaatttaaatatgtaagttgataaaatgtgacggaaaaagaattgtttctaagaagactaagttgactgctttggaaatacctggtaagggtgagttgtctgattaggtagatgaaaacgattaaaagccatgggacaatcataaaaacgtagaagtttttaatttgcaagtgttttttcacttctcattacactgagaacacttagaggatacatcacaagtgtgcttcagagaagaaaagtattaaggagttgaaataacagacttatttaaagaaaaagtcttggacctgtatcaaataattgaactaaagtgtcttttaaattaaaatctttaagataggtttgtatcacttaaaatccaaaaacgtttttcctctgcgttaaacaagttgaccatcttctgcatgtggctgcatgtgaacataatgtaatgataagctgttatgatatctttgtaaataaatgtaataaaaagaagtattcatgctacttagaaaatataatgtgctaacgcttacataattaagtgtctaaactgtaagaaatattttgtgtatgaaatgttggagagaagaaattaacccaacatcaa

SEQ ID NO: 6009 - DNA, 374 bp, Homo sapiens
ccaccaagcacttttaaccaaaaaacaagtttttcttgttgctttagttaaatgtgtccctgatgtaaggtttttttttttttttttccaaacatgagaactttataccacctgtgttacactacactgtgatttactgtgtacagatcggtgtcaatgaaataaagaataaaactgtatactaggcaaagaacttcgttaacctttgtttcaaactttattcacagacttcttcggcttaattagctgcaaagaatgaattgcgtataagcaaaaactgaaaagagctgtagtgtccaagggacttgagcttaaaaatattagagatctagattttatcagacccataaacaaaaatttcttaaaaagcagtc

SEQ ID NO: 6010 - DNA, 508 bp, Homo sapiens
gtggccgcagcccgagagcgtgacggacgccaggttggggcacctgtgaggagagtgcggtgacccggggctcactggcttgttaaagctacccaaccgccccatgggaccgagtggactcatttaccgaggaggactcgggccctgcgaggtcacttcatcctggcccaggtactgcagctccaaatcgtggggattctgtaagagcttgctacctgttgactgaggaggcccacgagttgagcaaaaagaatgattcctcagcagtcattgtgaaattttgtgggccacaagtattgtgcacacatgatccttgatttagagtcaacctgatgtccattatagctgtggaaaggcagcaggcagttgtgtcgctcttcacaataaggaacacatcttgctttcagcatgtgagaggaacaaaagcattgatgtaaatgtgcctcaaagtgagaactgaaaacattaacataaaataaaaaagtcaaataagactaagttcttacaa

SEQ ID NO: 6011 - DNA, 228 bp, Homo sapiens
gcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacc

SEQ ID NO: 6012 - DNA, 487 bp, Homo sapiens
attgcttcccacaaagttgccaactggactctgttataaaaattaaaagcacacatcacgaaaattcttggacttgcaaagcaataagcctactaacaaaataagtgctatagtttcttttgaaataaggcattctaattatctcagtatgtctgccaaccaaataatgggaaatcagggaactaacttaatatttaatacattaactattagtaaaataaaaacactcttacatccatggcctaaatactatagatattatagatgaggaaagaggcatttcctctatacaagggtgcttgctcaatgtacaataaaggtaataacacaaatattattcaagtctgtgtttttggttggggagttcctagttttaaaaaatactcatttggtgaaataaatcatcttgagatttttctgaaaccatgctgcttacaaggatttcccatattactagaatttttttacttttctgtaaacattttct

SEQ ID NO: 6013 - DNA, 510 bp, Homo sapiens
accctaaataactaagagttggctgtacgccttttttggggggtggggagggagacctgctttagctcctacacagatgactagattttgagttaactgttttaacattctggcattttgttctcttgataaagaaaaatcacacccttgccaagttcatgtattttaaaaaatggaaaactctccaggtcacggagtgaagaaaacacttaagtgttttatgtctaaatgaagcaataacaattctgataccagcaacatcccttttgatttaaaaaagattggtcctcacaatgttcaaattattctacacaaatgacctgtgaaattttttacagttgtatttttttgcccaagattcatcataaatcattcaattaaactaaattaaaattgattttagcagaaagtagaaatgtttcagaatataaaatatcacattactgattttacaatttgataacaactaaaaaaaaaatgcatgtcactaaaaaaatttttccagtcttt

SEQ ID NO: 6014 - DNA, 413 bp, Homo sapiens
gtcatatactgtactactttcacaaagatcacacagttttgcaaaagacttgtcatatgtacaatgctatatatcaaatgagaaaagctgtaagcaattatatacgcaaaagaaatgcagtatttacagtttgtcaggagacattagaaatcatctatacattaaattacattttgcttgcaaataactggtaaaacaaaatgagccatgtccacaccaaaatataaaaatctgtattgcatttttatacctaagatgcattcacagaactgctgctgacaggaaagaaaaaaaaaatcctcatagtgccattacttagctgagtacttaatgtgtatgtataaaataatagaacattcactaaatgaatttaactaaaaaaaaaaaaaagatcatacagcatcaaatcagca

SEQ ID NO: 6015 - DNA, 6387 bp, Homo sapiens
ctttatttgccttgtacagcatcaattttcttacattctcagttaattggccattaaagtgctggaaattttcttaatcatgataacatttgttaaaaagaaatcagaactaatatcaggaacatggcggcatgaaggaaacagttcccttacaaaacacagaaaatggaagcccctcatgttgagggggtgggttggacaatttgcaaacagattctaatttcctctcaccgtcagcaccaaactggctgggaccaccacccctgggtgaaagaaacaacactaaagaaccctaaaaacacccacacaccctgactaccaccacctctgggccatctgtgggcgtttgctgtttgaacagatccagtctcaggaaagaggaagacctgacctccgtctgcaacccatcaccccacccacccttactaacaaaagcccccaaagtcattacaatgaaaaagtgggtttccattaccccaaaactaacaatgttcagtaaaaatgaggataataaacacaaaagcttgcttagtaaacaggagctctcagcagtcaatgcaaaaaaatatatatatatgaaatcttaaggcaaatactgttgactttgcacatgggctggacgaacttggaactctttacctatctgtatagttccaggagcctacaggcggtcggtttttcagcgcttgccaccgggccaggcaaggtctttgcatgattgctgaggcagtcggtgtgtttccctttggagtttatataggaacacaccacccaaggctgatgttttgttatatatatatatatgtacacacatacaaaggcctgctactctttctttgtggaaactgacagctccacctcgggaagctggatgccaaccttattcccactgtcattgctagaagaggaggacagtcgggacttcttagaggccagggacaccccactcccctgtaacttgcctgtctcatcatcgctcccagtcacctcataatgacctttgctctttgaccccaatccaccaaaggtaccgaatttcagcttcccgtgtttccctttaactttcccaccttccagagacacttccccaccttcaaactccagcgtccccgtcggggtggaaggtccagagaactctctttcatcactgaatgaatttgagcggtgccgtggcttcttacttttaaataaggagaatttgcctttcggtgaagaggcttcggcctctgcctctccttccagagagcccaggctggcctttgaacttttcaggtcacctttggacccagaaattgatgcttctggtgagccagtgacaccacctttccctttaggtttggaaaaattaaacttgggcattttgatcttggactttttcagtttgacttcagactcttcccactcgccgtctccagcaccagcttggatgctggcctctgctttagggaagtgaacatccacccccatttctctgccaaccagctcacggccagagaaggtaaatttggggatcttcattttagggaatgttacttttccagatccactttccaagtgaccttgaggcccagacacactcagcccaggagcctggagtccaatctgacctcctttcacacctccttccacctttggtcctgagaaatgaaggcccccagcaaacttagatgtgtccaagttgagagcagaggagacttggggtcccttccactcacccccggaacctttaacactcaaatgcccttcaccaaggctgatgtctggggcactgacaccccctgaaacatccgcacctcctttgatttttgggcccttcaagttgatgccaaaatctgactcaggagatgccatattaaaggcaggccccttcacactgatatcaggagcagccccatggaaacctacttctgaacctttcagaccacctttgatttcaggcccagaaatctgcccagttgggagtttcacattcacgcctggcaggttcacatcacatccagaggacttaattccaggcatctggaggtttccttctaggccttgaacaccaatgcctggaagacctcctccgacagtggggcctttgatctcaccagtggccccaaggctccctttcacttttggtccttccaagttaaagtccacattcggtgctgaaatccgaggccctttcaggttcacatccacacctggccccttcagttcgccagaaacctgtggccccttggcattgacgtgcaagtcggaccccggagtagagatgccaaattggggcagcttcattttgggaagtttaatgctgccttcggatgcctccaagcttagatcaggagctcctacggatactttagggcatttgatgtcaccagagacagccagatctccctgcaggcttggtcccctcagtgtcacatctggtgccccaacgttaagctttgttgtggcatcgatccctggcactttcacaccgtctcctcccacctgcattttgccaccgacaccactgaggttgagccctggagcatgcaccttcatgctgggaacagatgcatccaggtctcccttcaaacttggtcctttcaagttcagatcaaggtcaggcccagagacttttggcatagagaggttcactgaaggcaagtctactcctggcccctttagagaaacatcgggcccttcgagcttaacatctggtcctctcaagtctccttcaagagagggtagctgggcatggacctcggctcccccaccctccattttcacacctgggatgccgatcttgggcatggaaaacttggggaacttaatttttgcttctggaccttgcagatctacatctggtccttccagtcccacgctggggacatcaccctttatctttggtcctttcaagtttacattcacatcagggatggagacttgaggggcagaaatgccgaaggacggtgttttgactttagcatctaggccttcgatgttgatgtcaggtgcacccaagtttgcctgcactttggggcctttcaggtcaccctctatttttggcactgagatgtccacatctggcatcttgaccttgggagccttcgccttgatgtcaagaccttcgacgtgaatcgctggcaaagaaagttccagatcaggtgcctggagttcaccctccagtttggggctagggagaggggcctcagctttaaatttaggtgatttaatgtcaaactctacatctgggaagtacatttttccaaacatcgttttcttggttttgggcgatttcacgtcgactttgagtgcagcatccggccctgcgatgttgacatctacatccggagccttgaggctggcatcaatttcacccccaggaacattcaggtcaaatccctgttttttggccttaatcttaggaccactcatatgaattttaggcattttaaacttacttttcttgcccttgccaccaacactaatttcaggagtctcaaggttcagctctgcctcaggaacagtgacatccagtgaaggtgacttgatgtcagctttggggctttttgccccaaatccaaacttgggtttcttaaatttggggattttaacatctggcccttcgatgttaatatctgggctgtccatgtgtacatctaagcttggagcttcaactttgggtcccttgaggtccacttcaccaccttctaacttcggacctgaaaatccaatttttggtgccttgagatgcaaatcaacatcaggagcagttactttaggagcagatatctccagcgatggcatcttcaaagatgggccactgagtttggcatcagggccttcgaaatccagacgtggacctttaagatctacttctgggcctttcaaagtcccttcaaccttagggacagacacatcaaaatctccttttactttgggtcctttcaaatccaggtcaacatcaggtatggagatcttgggagctttgatatttatttcaggcatcttgaacttggggcccttcagttttgcgtctggaccttcgatattcacatctggaatatcaacgtccaccttgggtcccgagacatcgatgtcggccttgggcaggctcacatccacatctggaccttctcctttgaagccaggcatgctgaatttgggcattttcaccttgggcatcttcaggtgccagtctgggccatgaacatccacatcaggggtgttgatgtccacttttgggcccttgatgtcagcttctgggcccttgaggtcaccttccactttaggaagggtaacatccacatcgcccttcactttgggtcctttcaggtttaagtcaatatcaggcatggagatcttgggggctttgatgctcatctcaggcatcttgaacttggggccctttagtttcgcatctggaccttcgatattcacatcaggaacatcaacgtccactttgggtcctgagacaacaacgtcagccttaggcaagttcacatccacttctgggccctcgcctttgaggctgggcatgctgaacttgggcattttcatcttgggtattttcaggctccagtccaggccttggccttccacatctggtgctttaatatctaccttgggacctctgatgtccacatctggaacctgcatttcaccctctatctttggtgcagagatatctacatttcctttcattttgggtcctttaagatccaggtcaacatctggcaaagacatcttaggagctctgaagtgcatctcaggcatcttaaacttcgggcctttcaacttcccttcaggtccttcaaggctcagatctggagcattagtatctacttttggtgcagaaatgtccacattcgctttggacaggttcacatcaaattctggcccctctcctttgaggctgggcatgctaaatttgggcattttaatctttggcatcttcaagttccagtcaggaccctgcatttcaacatctggggcactgacatctacttttgggcctttcaggtccccttccagctttggcactgtcatatcatattctccctttactttaggacctttcatatgcaagtccacatcaggcatggagatcttgggggccttgatattcatctctggcatcttgaacttggggcccttcagctttccttcaggtccttcaatattcacatctggaacttcaacacccaccttgggtcctgagatgtccacatcagccttgggcaggttcacatccacttctgggccctctgctttgaagccaggcatgctgaacttgggcattttcatcttgggcatcttcaggtgccagtctgggccttgaacctccacatctgggacatcaatgtccattttggcacttttaagttcaacatcaggaactttaatctcactttcaacctttggcattgtgacatcatattctccctttacgttagggcctttcagatgtaagtccacatcaggcatggagatcttggggactttgatgttcatctcaggcatcttaaacttgggccctttcaatttcccttctggttcctcaatgctcacatcaggagcagtaacatctatcttgggcccggaaatgtccacatcagccttgggcaggttcacatccacttctgggccctctgctttgaaccctggcacactgaatttgggcattttcatcttgggcatcttcaagtgccagtctgggccatgaacatccacatctggggcatcaatgtccacttttgggcctttgagttctccttccagctttggtacagttacatcatactctcccttcacctttgtacctttcacgtgcaaatctacatcaggcatggagatctttggtgtcttgacactcatatcaggcagcttaacatcggggcctttaagttttccccccagaccctccaagttgacatctggggcttccacattgaccttgggccctgaaatactgatatctcctttgggtagagtcatatgaacatctggaccttcccctttggctcctggagtgctgaacgtgggcattttcatcttgggcattttcaggttccattctgggccatgcgcttcgacatctggggcactgacatccactttggggcctctgacatcaacttcagggactttgactttcccttctactctggggagtgtgacatctacaccccctttcactttaggtgcggccacatttaagtctacttctgacatagagatcctacaggttccggttttcccggaaggactgccaagcctagggcctgtcaaggttccctctaggtttggtgtctctatgtccactctggagcctttaagtgccacttgagggcctttaacatcaccttgcaccccaggagcagaaaccttaatatctcctttcagtttagg

SEQ ID NO: 6016 - DNA, 2220 bp, Homo sapiens
ctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccc

SEQ ID NO: 6017 - DNA, 7048 bp, Homo sapiens
atgccctagggctagtggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatgaaaacaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgtatatctatatgtgaaattgaaccattttctcatagcatatagaaaaatcaactcaaaatggattaaagcctgaaatgttgcctttgaaactgtaaaactactagtagaaaatataggggaaaagctctatgatgttgttctgggcaatgatttcttggatacatccttaaaagcatgggcagcaaaaacagccagacaactatcagggaacctgcccagatagtcacataggttcttttctattttccctaagcattggccgggttgagaaataaagggacagagtacaaaagagagaaattttaaagctgggcatcctggggagacatcacatgtcggtaggttccgtgatgccccctgagccgtaaaaccagtaagtttttattagggattttcaaaggggagggagtatacgaataggaggtgggtcacagagatcacgtgcttcacaaggtaatagaatatcacaaggcaaatggaggcagggcgagatcacaggaccacaggactgggttgaaattaaaattgctaatgaagtttcgggcaccatcgtcattgataacatcttatcaggagacagggtttgagagcaacctgtctgaccaaaatttattaggtgggaatttcctcgtcctaataagcctgggagcgctatgggagactggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaatttctgcacttaacacaattatcacagggtcctgaggcgacatacgtcctcctcggcttacgagatgacaggattaagagattaaaacaggcataggaaatcacaagggtattgattggggaagtgataagtgtccatgaaatcttcacaatttatgtttagagattgcagtaaagacaggcataagaaattataaaagtattaatttggggaactaataaatgtccatgaaatcttcacgatccacgttcttccgccatggcttcagccagtccctccgtttggggtccctgacttcccgcaacagacaacttgagttgcatcaaactaaaaagcatctgcactgcaaagggtacagttaacagaatgaagacacgggttttgagaaaccattttcaaatcatatatctgataaggggctaatatccaaaatgtattaagaaacccaagcccaatagcaagaaaacaactgtctttaaaagggggaaaaggacctcaacttaaatttttcagaggaagacatgagtggccaattgattgatacatgaaaaaaatgctcaacatctctaatcattagtgagttgcaaatcaaaactgcaagatattaccttacaccttttagaatggctattattaaaaggatgaaagacaggtgctggcaaggatgtggataaaaggaagtcccaacattctgttagtgggaatataaattagtatagccaatttaggaaactatatggtggttccttaagaaactaaaagtacaattactatatgatctagcaatctctacttaggtatatatccaaaggaattgaagcagtatgttgagatcttgcactcccttattttgaaattatttacaaagctaataaatggaaaagacttaagttttcataacagatgaatggacatagaagatgtgttgtatatacatattggaatattttttatccttggaaaagaaggaaaattgtcatttgtgacaacatggatgaatctgtagtatactatgctaagtgttgtaagacaggcacagagaggcaaatactacattatatttgtatgtggaatctaagaaaggctaactcatacaagtagaaagttggatgttatggtttccaggatgtgggtgttggagagatgggcaaaggcaagacgttggtcaaagagtaccaattttctgttaggaggaataagttttagacatatttcacagcatggtgaccattgtcactgactgtatattttaaaattgttataagtagatattaaagttgtcacaacaaaagtaggtgaagttatggatatgttaatgtgcttgatttagttattacactatgtatacatacaaaaacatcagatagttccctggaattatatacaattattacttgtcaattataaaaaaaagccctactgcaaccactaaaaaggattttcatataatagagggaaaaatcgttaaagataataatacattattttagaaaatattaacttataaaaagtagtataggagggattctgtaaaagaagatagacatagaattttaaaatgtataatggaaaatttaaatccagctgtactgatggatcaagcaatccaaaccagtctgattgaccaagtggatatttaaaaaacaatcaaactataaggtgtctgttgtaggcagtttataaaatacaaaagtgttgaaagaaataggatggaaatagaaatatccaagtagcaaccacaaaaaaactggaatgtctgcactaacatcatacaaaacaaaccaaatgaaggttaaaaatattgaaattatacaaaatatgttctatgactaaaatttaatgaaattagaaataacacagagataggaactatacatatttgtgcaaatttaaaaagttatgctgagtgtggtggctcacacctgtaatcccagcactttgggaggccggggagggtggatcacttgaagtcaggagttggagaccagcctggccaacatggtgaaaccctgtctctactaaaaatacagaaaattagccagatgtggtggtgtgcgcctgtagtcccagctactcgggtggctgaggcactagaatcacttgagcctaggaggcagaggtggcagtgagccgagatcacaccactgcactgcagcctgggcgacaaagactgtcaaaaaaaaaaaaaaaaaaaaaaagttacgtaaccaacaagtcaaaggagaatttataaggaaatcagaaaatactttgaggtgaatgaaaatacagaaacaacatatcaaattctgtgagatgtgtgaaagcaacgcttacagtgaaattaatagctatgaacattgtaatgaaatgagaagtacttcaaattactaacctaactttccaactttagaaaatacagtaaaaaaagaacaaattaaaatcaaagcagaaaggatataaagtttagtgtggaaatagagaattaaaaataattgagaaacacagcacttcgttgacttattcataaaataaagctttattaaaatgagaaatgtaaaacgtgatgttcctaatgaccttattccatacaagggattagtattttgacaaatatctttgtggaagtagacaaattcctagaaagacactgactaccacaactcattcaagaacaaagtgaagacaataaattggtaatttaaaaactctcacccctgcccctgacacacatgtaaattcccagttcaaatgtattcttttgtatattataccaaacacatgaaaattaccaattcgataaaaatgtcttaaaaacttggaagagcatgtaatattttttactggttctatgatgctattgttatctagataccaaagtgaaacatcatacacagggaaaactctgataatatcgcttatgagtggatctgtgaaatttcctagtaaattttggcaaaccaaatacagtaacatataaacaggaatgtacaccagtacccagtacagtgtatccctggaatgcaacgttatttcatcagctggaaatgattagtgcaacagactgaaggaagaaaacaacatggtcatctcaatagattgtggacggctggaagtggaggctcacgcctgtaatcctaatactcctaccaacagtgtataagcattcctttttctctgtaacttcaccagaatctgtttttttgtttgtttgtttgtttgtttttgactttgtaatagccatgggctgggctcagtgactcacgcctgtaatcctagcactgggggaggctgaggtgggcggatcacttgaggtcaggagttcgagaccagcctggccaacatggtgaaaccccatctctactaaaaatactaaaattacctgtgcatggtggcaagtgcctgtaatcccagctactcgggagtctgaggcagtagaatcacttgaacccaggaggtggaggttgcagtgagcggagattgtgccactgcacttggacctggctgacacagcaagactatgtttaaaaaaaaagagagagaaaaaaaaaatagaaggtggaaaaagtatttggtaaactaagaagtaaaccacaacctagtaaagggcatattttaagaattcacaactagaacctggtgccgtggctgtaatcccagcacttggggaagccaaagcaggattacttgaggccagaagtctgagatcagcctaggcaatataaggatactctgtatcttaaaaaaaaaaaaaaaatccagatgtgatgacacatgcctgtacgcctagctacttgggaagctgaggttcatgtttacaatgagctatgatgatgccactgtactcctgactgaacaacagagtgagaccctgtctctaaaaagcaaaacaaaacagaaaacccaaaaccctcaaaactaatgttacacttagtatttaaagaatgctttctctgtaagaagaggagcaaggacaggataaaacattcttgccagttctgttcaacagtgtactggaagtatctgtgacattaattgcattgcatatggaaggaaataaaattttttaaataggaagcagcaaaaccttttgcagatgacatggttttgtacatacacaaccccagtggatccaataaatttggattccaataacaagatcatctcagcaagtttttgtgatttaagattacaatccaaaaatcagttgtatttctatatattattaaagaagtcaaaagtgacatcattgaaacatttttatttacaatattattaaggcaaaatactgtgggataaagtgaaattcagcatgaactgtgaataacacaaaatatttgtcagaggagttgaggaatatctacatatgtggaaagacatctcatatttgtggactagaagatttaagcatcgctaggtgcggtggctcacgcctgtaatcccagcactttggtaggctgaggt

SEQ ID NO: 6018 - DNA, 12427 bp, Homo sapiens
agacccttgccatcagcagaggctgccgctgcgcgtcccctaggcgcggaagaggcggctggtggtccctgacggcaaggtgaagtcgaggcagtaatcgggaacccaggttgggaggacagaatggggaacaggaagctggggcgagggtggtcttgggggaggtggggggccgcggaattctaggtggcccctgcctcacctctggaaagaaccggaagcccgggccggggagggtgaagggagtcgcggacccggctgctcagccgaggaggaaacccggaccccaggctgagggaggccgaagaaggaactggagggccgggctgggaaggcctgaagcgggtacagcctttaggctggggagggtcgaggggagaactcggagcctgagtcgggcgaggttttgctccactctggcttctaagtgtgggggcctcaggatgtgacccgtggtcgtaaacctgagggtgacttggagtttttgtccgttttgcaccatgagaaaggccccagatggaatctggcaggtagcggcggttcagtgtgtgtgtgtctgccttagggcgtgttttacactgttgacgaaaagactcagactctaaagtatttgaagagacttattctgagctaaatatgagtgaccaatggccggtggcccagccctcaggagatcttgagaacctgtgcccagggtggacgggatatatgtggttttataccttttagggaaacatgagacaccaatcaaatacatgtaaaatgtacattgattccctccggaaaggcgggacagctggaaggtggctggccttccaggtcataggtagattcaaagattatttgattggcaatgggttgaaagagttattgacgtaagacttaggaatgtctccaggtagcacgcttcacagagaatagattgtaaatgtttcttttcagacttggggtcttttctatcagtaattccaaaatggaggagggtataatgaagcatgtccgacccgcccacccccgcctttccatcatggctttactagtttttcaggttaggaatgccctggccaagaggaggggtccattcaagatggtctgggtgtgcttaggattttatttttggtttacaacaccagcaccaccggagtttgctggtgtcctttccagtcagtttcaaagcagagacagccatagttctgatttgtgtcactgtaactgtcagttccggaattccatatttctcctttagtttaccctaatgtgtgtgagatttcatgtgtagttcatttttctttttctgaacagcactccattgtgcaaatataccacaatttgtgtagtcatttttctgttgttgaacatttggcatatttacaggttttatacattacgaataaagctggcacgtttccatttctcctgggcaaatatttagaagaaaagttgctgggtaattggtggagacaaggtttcgccacattgactgggctggtctggaactcctgagctcaagcaaccggccctccttgacctcccaaagtgctaggattacaggattaaaaatatgcatggagctgtcatcgcctatgaaaacaatgccttcttctggatacctcctgaaggacttgcctgaggctgttttacagttactttttttttttaataagtagaaggagtacagtctaaaataataatacaaatagtacaataaattacataaactagtaatgtaatcacttattattatcacctattacgtactatacataattgcatgtgctatacttttatacaactggaagcacagtaggtttatttacagcagcgtcaccacaaacacctgagtgatatgttgcatgacaacgtccacaagtgataggaatttttcagctccattgtaatcttatgggaccaccattgtatatgtgtccatcattgagtaaaatgttattacatgacacatgactgtgttcatcaggaatatgtatgctagtatgaacctataatgagagtgttaaattttatgaagcaaaaactaacagaacaaaagaaatagatccacaagcataattggaaatccacaattatatctcagtaattgatagcacttgtaggcaagaaattcagtagtatatgtaatcagctcttcatatatgcagattcaaccaatagcaatgcacaaatattcagaaaaaacacaatgacagtaaaaaaatacaaattttaaaatacagtataaaattatttacatagcatttacattgtattaagtattataaaaaatctagagatggtttaaaatatacagaaggttgtgcataggttatatgcaactactacaccattttatataacaaacttgggcatctgtaggttttggtatccacaaggtgtcctggaaccagtcccctgtggatagcaagggacaactgtatagaagatatgaaccacaccagtcaacatgacctaattgttgtttacagaacaccatacccacaattgaaaaattacattcttttcatgtacctgaacagtccccatgatagactattggctggaccataagtcacaataaacttcaaaagattgccacattacagggaatgtgcattagaaaccaataataagaaacctatacagtccttcaatacatggaaattaaataacacacttctagatctacagatcattgaataaataaggggaaaatgttttgaaatatgaaaaagtgacaacagcatatcaaaattggaaggatacagctaaagcagagttgagaggaatgttaagtacttaaataaaaaaaggagaaattcatagcagcattattcacaataaccaagaaatacgtacaacccagatgttcatcagtggatgaatggataaacaaaatgtggtaatatgatttggatatttgttccctcaaaatctcacacggacatgtgacccccagtgttggaggtggcgcctagtgggaggtgttggattatggggtggatctcatgaatggcttggtgtcctccacatggatatgagttcatcctatagctagttgtttaaaagagcctggcacctcctccctctcccttttgttccctcttgccatgtgatatgctagctctccctttgccttctgccataattgtaagcttcctgaggcctcaccagaagcagatgctggcactatgcttcttgtacagcctatagaaccataagctaaataaaccatttttctttataaattacccagcctcaggtattcctttatagcaacacaaaacagactaatacatgtggcatatacatacaatgtaatattattcagccttggaaggaaattttgacatatgctacaatgtggctgaaccttgaggatattctaataagccaatcacaaaaagataactacttatgattccactcatatgaagtatctagagtagtccacctcataaaatcagaaagtattactggtctcccacttttaggctattaacgcttgtagtgagagtttgtaggtttcttgtcgtggttgccaggggctgggggcagggggaaaagggtagttattatttcatggatatagtttcacatttacaggatgaaaaagttgtggatgttggttgtacaaaaatgggaatatacttaatgctgctgagctgtatactcaaatagttaagatggtaaattttatgttacatgtatactttgccaccatttttaaaaatgaggaaaggcttaaacaagaataataaacatgctatatgctaaaccaaaagtcaaaaaaaagaagtaaagatgggcataaatcggctgggcgcggtggctcacgcctgtaatcccagcactgtgggaggctgagacgggcagatcacgaggtcaggagatcgagaccatcctgactaacatggtgaaaccccatctctactaaaaatgcaaaaaattagccaggagttgtggcaggcgccgcctgtagtcccagctactcgggaggctgaggcaggagaatggcctaaatccgggaggaggagcttgcagtgagccgagatcgcgccactgcactccaggctgggtgacagagcgagactccatcttaaaaaaaaaaaaaaaaaaaagatgagcataaatcaattaagtagaaatagaaagcagaccattaagaaaatgaacaaaacaacaagtttatgtgaaggtattttaaaaatggataaatccctagtaagcataattaataaaatagaaaacacaaattgcccatgtcaggaataaaaatgaagatgccactacggatcctatagacagtaaaatgataaggcaatattatgaacaattttatgccaataaatttgacattttagatgaaattcatccattcctttaaaagcacagcttctcaaaactcttgactcaaaatgaaatagaaaaacagaaagtctgtatctaattgtttgtttgtttgtttgtttggagacagggtcttgctttgtcagactggaggctagtggcatgatcatgactcactacagcctcaacctaccagtatcaagtgattcttctgtctcagcctcccaagtagctgggagtacaggtgggcaccactatggccagctaattaaaaaaaaaatttagagacagggtctcactttgttgtgcaggctggtcttgaactcctgggctcaagaaatcctcccaccttggcctcccaaagtgctgagatttcaggcatgtgccatgacacctggcctaaaattttaagttttaataaataaaaatccatacatacagaaccaggttcagctccactgaaacccctgcaactcagccaaaagtaaatgtaacatggttttgaatgctgtcttaatccagggcacatgaaaaacccttaaaaacaaaaacaaaaacaaagcatacctctgccccaccgagatgagctcaaaaacaaacattacaaacaacgaggaaataaccatcacaggagggtcagcagagtaaataaataataaagttggcacctacaagaactgcatataatatgacaatatgaaagaatatgaaatgttttaaatggaaaaaaactcataatgaaagcataatacttaaaaagaatcagtagatttaaaaaataaccagagaaaatttctagaaataaaaaagatcttaagtatagagaacataacaagcacagctcaaaattaatgaacttaaagatatatctgaagagattacctataatgcagcacagagataaaaagtgaaatacagatgagaaactgagacatggaagaaaataaaagggcccaagacacatctaataaatgtcataaaaggagaaaaaggaggagaagcatcagaagaaaaagtggtttacaacttttcaaaattaaactcaattttaagatgaggaatcaaaatgagtgtcaagtaggataatgaaagtggatctaacacctagacacatcacagtgataatgcaaaacagaaatcttgaaaagaaggaagggagggaaggaaagaaaagaaaaacagaaaagacatgctacctaaaaggaaagatgattgggcacaagatgtcagaagacaggagaataataccttcaaactgatagaggaaaagtagcaattaagagtggggcaaaataaagacattttcagacaaagataaggtttttttcatagactcactggaagaatttctaaaggatgtgaatcagcaaaaagaaaaacccagaaagacagaatgagataaaattttaaatgatgagcaaggaaattggtaaatatgttggggattctgtttactaagtaatgatgattactttttacggaatttcaaaacaaattagatcaaaagcaccagacaaaaatagaaagaggccggatgcggtagttcacacctgtaatcccagcactttgggaggccaagatgggcagatcacttgaggtcaggagttggagaccagcctggccaacatgctgaaaccccattttcactaaaaatacaaaaatcagctgggtgtggtggcgctcacctgtgatcccaactactcaggaggctaaggcaagataatcgcttgaacccaggaggtggtggttgcagtgaaccgagattgccccactgcactccaccctgggtaacagagggagactctgtctcaaaaaaaaaaaaaaagaaagaatgtacctacagcattctaaggtcttttttattgctcaagaaggagataccaattagtcattaagtcaaagatgcaaggttaagagtaacttccgatagtaaagcaatacaatatcttatttttaatccagtgcaggggaaagtagaataaggagcacttaattgatctcatagaagtcaataaaacataaaagaagcagcaagtataagcctgattaaacagaaagtggggaaagagatgggtcattgagctaaggggaggcctggtgacagctcttggaagatgaagtctgaccagaatagcacataagtcaatcaggttgctgtggccaaagtgcatcgtccttgcctctctgagtttgtagtggggagaaacaacaaacccaacactaaacatggaggaaagaattaaagactcaggcctatcagtttccactccctgccctcccgttactaccagtttaaaggcttacaggggctcatggatgagtgggaagtttttgtgacgtttgatagagaaatgagctgcctcttgaccagcagagagccccaggttcatcctcatgtggagtaacagggctgcagagcagtcagtgttccagagccctgtgctcacagatctagctacaatccccacctgcactgtttttagttgtgtatatcccttaatgttactgaacctcattctcttctgatgtaaaatgaagacaggcatttctgctcaacccatttcatctgtaaatggagggaataagtctttatgaaatgagacaaagtatattcagtgtctgcagtgcagttaataaattagtgtctttctacctgtttctcacaaaactgaaataaaagctggaaaattgctttgtaaaccataaggcactctgcatacaaaagagattactatgaatttttcctaagtgattaactcatgactcctttccatactcctcagcagtggcaacattgggaggctggattttggtgggatggaagataatgaggggactctggtttctggccagctccaggactggatgtgatggttaacgatacttaacatcaccacacagctcattccctagctggctcagtaactatggatctctaagcaatgtcttaacatttacgcttacatctgctaagctaagtatgtactgttccttgatttacatgccacattgattttttaaggggtttcaactgtggatcatgaggcagaagaggtgacaatgaaaggtcaggcaaagacaggagtgtccagtgtggaacacgaaatcccatcctgactataaaacattatatgctgtttattacattttaacttcagaaattatcgactccattttccatttccttgcaatatgtattgagcttttcagtcctgttttgtcatcatgcaaacaagtaaaattcttcaggatgcagacccacctaatagtactaaaaaggaatctttaaaaaatatggagatgtcttctccctatggagctacaggggaaaagacaccactctgtgtcataaaatctatttaaatggttgccgggcgcggtggctcacccttgtaatcccagcactttgggaggccgaggcaggtggatcatgaggtcaggagttcaagaccagcctgaccaatatgatgaaaccccgtctctactaaaaacacaaaaattagccgggcgtggtggtgtgcatctctaatcccagctactcgggaggctgaggcgggagaattgcttggagccaggagatggaggctgcagtaagctgagatcatgccattgcactccagcctgggcaacagagcgaaagcgagactccgtctcaaaaaaagaaaaaaaaaaagctatttaaaagaacctgatatgataaagtattgaattgagaacactcagtgaatatcagcattactctcctgttcagtagagagataactctgatcatcctcagctattttcctgtctataatttgcttatttgtattatttgtgcaaagaagtctttaacacctcatatttcaatagtaatcctaaatcctgttgtttatgtcataattcgctgccctgataatgcttaaactcatctctgtttttctaaaagacataaatatgtataaggtttctatattaagaaaaaagacgagtatgctgtttctgtttacttctatcagcataaaggtataataaaatcccatgagtggctgggcgtggtggctcacgccggtaatcccaacactttgggaggctgaggcaggtggatcacttaaggtcaggagttggagaccagcctggccaacatggtgaaaccccatctctactaaaaatacaaaaattagccaggcgtggtggcgagcacctgtaatcccagctactcagtaggctgaggcaggagaatcgcttgaacccatgaggcggaggttgtagtgagccaagatcatgccactgtactcgagcctgggtgtcagagcaagactccgtctcaggaaaaaaaaaaaaaaaatcccattagggaaatgcacaacaaaacaataatgagataacctactacgatggctataatttattttaaagtgttgggaaggatgttgagaaataaaaactcttttaccctgctagtgggaatgtaaaatggtccagttgctgtgaaaatcaatctggcagttcctgaaatggttaaacataatgttagcgtataatctccagttctgctcctcagatctacctgacagaaatgaaaacatttccacactaaaacaggcacataaatcttcacagaagcattattcacagtagccaaaaaatggaaacaacctaaacatccgtcagctgatgaatgggtaagcaagatgtcatatccttaccacactttagaatattattcagtcataaaaagaaagtaataatgatacacgttacagggacgaaccttcaaaacattatggtaagttaagctagtcatgaaggatttacatactgcatgactccatttatatgaaatgtccagaacaggaaaatctctcaagaaaaagcacattaacggttgcctagggctggagggcatgggggtttgaaagtgacagctaaggggagctggatttctttcggagatacatacgatctaaaattgtggtgatgcttgagcccaggagtttgagaccagactcgccaacatggtgaaaccctttctttactaaaaatacaaaaattagctgtgtgtggtggcatgtgcctgtaatcccagctatttgggaggctgaggcaggagactcgcttgaacccgggaggaggaagttgcagtgagccgagatcatgccactgcagtccagcctgggtgaaagagcaagactctctcaaaataaaataaaattgtggtgaagaatgtataactctgtgaatatacaaaaatccattgaattgtacactttaaatgggtgaattgtatatgaattatggctcaataaagtggttttaatgtgtctcatgccttaagggattactagtttagtatatggtctccagtagtggtttaatgaaattccgtgggagatctcttgagctttattcagagcgttgttttaccctcctagtgtccactccctgctgtctttgcataggagaaccacagtcctgtattcagaggtaaaagtggataagtatctcatgatttgaggatagataggtgtgatggaaagagagttgtcattcacttggtctgccctgttccctaagtgtatgtttgcaccccacacctctgtcatccttgttctgaaatgagtgctattctacctcaggaacatactgatgacccccagcactgtgaaaatcagaacagtgaatggcaagattcaaaggggccatgacaaatattagggaaatggaaaagtagaatgagatccatccattgtggatcaaacctaacagacaatggcagcaagaagtggggagagaagagaaactttctctgaagtcttgcctattctgtgcctccaacaatatgccccttccccataacttgcccaacgaatctcttcaactgtatcctttgtaatatcctttataataaaccagcaaacataagtgtttccctgagttctgtgagcacttcagcaaattaattgaacccaaagagggggttgtgagaaccccatcttttttttttttttttttaagacaggatcacgctctgtcacccaggctggagtgcaatggcacagatcactgctcactgtaaccttgaattcatgggctcaagtgagcctttcacctcagcctcccaagtagctaggactacacaggcttgtacctccaggcacagctaattttactttttattttcttgagacaggtctcactctgttgcccaggctggtcttgaactcttggcctcaagtgatcctccagccatgagccactgtaaatgtctgggaatgccaacttgaagcccagctggtcagaagttctagaggcccagacttgcaactggtgtctgaagggatggcagtcttggggactgagccctcaacctgagggatctgatgctatttccaggcagatagtgtcagaattaaattggaggatacgcagttagtgtctgctgcagaactgattgcttgcttgctggtagggggaaatccccacatatctgggggtcattgaagtctttggtgttgactcttactgtgtttgttgttttcatgtgagagcagaggaaaagcaaggaaatgttttcctctggtcagttttccagaccagtctttacagaaacacacacagagcttcaaacaacactacacttacacagccctaaaagttagtaagtacctctttcagttctgcactccaagcacttcaatgatttcagccttactgtagtcctggtgttgatttttaacatccatctctcagcaactggcaaaaaaaaaaagacaaaaaatatcagtgaagatatatggattatcaaccaacttgataaaattaatattttgcacaataatgcacctaacaactgtaaaatacatgtccttttcaagtgcacatgttatattcaagacagaccacatactaggccataaaaaaagcatccgtgaatttcaaaggatcaaaatcgtacacaatgtattctttggtcaaatgaaattaggaatcattgacaatgaagtacctagaaaacccacaaatgtttggaaattaaacacacttctatataatccataggttaaagaagaaatcaaagggaaaacgaaaatagtttgaactaactgataatgaaaatgcaccatataaaaatttgtggggccaggcatgggggctcatatgtataatcccagcactttcggaggccaaggcgggtggatcgcttgagctcaggagtttcagaccagcctaggcaacagggtgaaacctcatatctacaaaatacaaaaattaacaggatgtggtggtgtgcaattgcatggctgtggtcccagctatgtgggaggctgaggcagaaggatcgcttgagcccgggaagtcgaggttgcagtgagccatgatcacaccactacactccagcccaggtggcagagtgagactttacctcaaaaataaataagtaaatacataaataaataaaaagaaaatttgtggaatggagttaaagtagggattctgtatttaaatgcttatattagaagagaaggcctagaatcaataactacaggttctactttaaaaggctagaaaaggaaaagcagagtaaaccctcggtacccagaagaaaggaaataagatgagagaaaaaaataaatgaaatatataattagccaaactaaaagtgaattctctgaaaaatcaacaaaattgataaaaccttgggtgggcatgacggctcatgcctgtaatcccagtactttgggaggccgaggcgggcagatcacctaaagtcaggagtttggaaccagcctggccaacatggtgaaaccccatctctactaaaaatacaaaaattagccaggcatggtggcatgcgcctgtagtcccagctactctggaggctgagggaggagaatcacctgaacctgggaggtggaggttgcagtgagctgagatagtgccactgcactctagacttggcaacagagcaagactccgtctcaaaaaaaaaaaaaaaagagttgataaaaaccttagctagaattatcaatttaaaaactgcaaagacaaattacatgaaagaacttatcactaaggagcattttagatattagaagtctaacag

SEQ ID NO: 6019 - DNA, 248 bp, Homo sapiens
gcagctggactcagtttagatgatcccaattttgttggcaacatccaaagcatcgtaatcaggagccagtcgaacatatgccttcttctctccatcaggtgggtgacgtgcggatcttcttctttttgtggctgtggacacctttcaacactgccttcttggcctttaaagccttcgctttggcttcagctttaggaggggcaggagcttccttcttcgctttcggcgccatgttgtgaaaagggtcc

SEQ ID NO: 6020 - DNA, 14871 bp, Homo sapiens
atatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgtattttgatgtgacaatttctaactcac

SEQ ID NO: 6021 - DNA, 1286 bp, Homo sapiens
acctccctcaccaaagcccataaaaataaaaaactataacaaaccctgagaaccaaaatgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgag

SEQ ID NO: 6022 - DNA, 8119 bp, Homo sapiens
gacttggttcaccggttaaaacgcagagggagatggaaatgaccaggagtcgaaaggagaagtaacaatgcctggattttattcagatgctgtgtacccagccaaaagactacatttctcaatctccattgtagctggatgtggctgtgtgatcaagttatgaccaatgagatataagtagaagtagcttggccagacacagtggctcacacctgtaatcccagccctttgggaggccaaagcaggaggatcacttgcactcaggagttggaaactgcagaccagcctggagaacacagtgacaccttgtctctacacaaaatgaaaaagttagcagggtatggtggcatgtgcctgtggtcccagctacttccagctacttgggaggctaaaatggaaggatcgcttgagcctgggagattgaggcctcagtgagccatgatcatgccactgtactccagcctgggtgacaagagcaagaccctgtctctcaaaaaaaaaaaaacgcggctgggtggaacatctggaaaacatctttaaagaacgctgactcaatcaggaggagcaccattttgtttcttgccctctgcccttcctgcctgaaacagagtctcttgctctgtcacccaggctggagcgcaatggcacaatcttggctgactgcaacctccacttcccaagttcaagcgattctcctgcctcagccccccgagcagctggtattacaggcatatgccaccccacccagctaatttttgtatttttagtagagacggggtttcaccacgttgtccaggctggtcttgaactcctgacctcatgatccacccaccttggcctcccaaagtgctgggattacaggcatgagccaccgcgcccgccaccttgattattgtttaaataaaagatgaataaaagtacattcttatttttgattataatgtggcccaatgtatacatttcacttagtgtagcacatcacattgttcttactaaaactatttctagttttacaccagctcagatttttaaatattcattgctttttcctacttctgtctcaggcattgccattctcttcaaaacatatttgaaaaatgtccaggcttctcatctctgtgtaaaactgttcagtttgttccagtgtgacgagaagaaattggactgagcatacttttttgtgagacatccattttcttcctttgatgaatttgacaacttgtgacaattctcacattttggaacaagtctcctaattatagaagaagctaataatgataatataagaaattataaattatttgactgttttcaatttatccaaaaggaagtttatcaaactttctcctcctactttctgctccaccccacccctcagccccgatgcacacgctgtgccgtcacagcacttatgcctagagaattatgatccttaaatagcagtcaactcttcttaaatagcagtcagttgttctagcagtgtatcagttagacattctagaatatttcacaaaataagaattttgcagaaggaacattatagctccctaggtctagcaaatgagggaactagggtacagagaaattaagtgacttaagatctcacaacaaactagtggagtacttctacttaaatatatctctagatactcatagaaggtaaaagctacattgaaaattcacacaactcttctggaaagtggcaaattcaatgatgctgtaaagtctggcataatattctagtggtcaagacactttgggtagtaaatgagagaggccaaattcaaatcaggctaagaataaaaagaaatgttttctttcaagtgggtggagctcaagtaagtgtaaattccaggggataaattggattcaggcatagctggatgcaaaggctcaaaaatgtcatcagaatctgcctctttttctctcttggtgttgcttgccactgtgttgtcctcattctcaggtagcttgactcacacagctacaacaatggcttatatcctaatggttgatcagccacagggcagagtacacttttcctcagtggtccaagcaaaaatcctggggctcactcttactggctgacttggatcaggtgtccttctggagcacaacacagtgactccaggtggccaagcttgaatctcatgccacatccctaccaccagctccactaaaaagaaccacatggacagaaggggaggagtggttacaaagggaaaaataaatgtttattacccagggagggataatgaatgtaaggcaagcaaaaacgggaaaaaaaaaagtccattaaaaattcaatttacactatttacactcacattgcactgtaaactgatgcaattaagagtctcatttcttgcttggtggttagggatttatatttcattaaaaaaaatactaccaacattaagtaaggggatacttgaagaaaacaaagatatgcgatgaagaaaactgggctttgcaaaaaaaaaaaaaaaaaagatgtactgtgagtatgtgtgtgtttattatattgttagtccataaatgaacacaaaggcaaatgaaaaataaaaacactggacatctgccaaacattacattaatctcaatgtttgatgattccatcagtcctgcactggggaaagcagtcattatgtttttgtggtagcatttgtttattttggtttccatatcatctcaaatgctgatgagcttgtgctagctacgtgtactagtattttattgaaaggcatataattatttagttcataaagagaagtagtctcatacacggccaattctttatcataactagcattctcttcatttgtccattcattcattcgtttatattaagtgccagttaggaactaggaacaaggctggactctaaggagatgactaatttgcagccccaccctttgaagtcaaagtaccgtaaagagaaacaggcaagtaaaaattaaagtacaccatgacaagtgattaacacagggctttagaaggagaggaggactctaagttagagatcaaagaaagcttcaaagatggcttagggaatgctttccagggtggaaaggaggttaaaggcaattctagagaaaataacatacaatgacacagagacttaaaagaaccctgggtgtttaagaaatgggttacaactctggctatgacatagggtgtgtacaggggaagagttgatgtgaatgactttgtgtgctaagtttggactttgccttgtaattctaaaactccctcagctggaaccagactgacagtaaagagccatctggataacttgttaaaaatacagattgctcagacctcacttctagaaattttgattcagaggaatctgtgttttaaaaaaatttccagctgggctcagtggcacgcctataatctcagctacttgggagactgcggccggaggatcacacgaggtcaagagtttgagaccaacctgagaaacatagcaagacctcgtctaaaaaaatgaagaatttcctatgtaattctggagtacatccaagtttgagaaccactgtgtgtaggaaatgaggatccgtcaaagggtcttgggaaaaataataacatactttggaaagagaggccgggcacgatgcctcacacctgaaatcccagcactttgggaggccgaggcgggtggatcacctgaggtcaggagttcgagaccagcttggccaatatggtgaaaccccacgtctactaaaaatacaaaaattagccgggcttggtggcgtgcacctgtaatcccagactttagggaggctgaggcaggagaatcacttgaacttgggaggcagaggttgcagtgagccgagatcatgccattgcactccagcctgggcagcagagcgagactccgtctcaaaaaaaaaaagagagcccttttttccagtggcaaattgctttacagcatgtcaaaacaggagatggagagacctgataaacgagtgtgtgacagaacaaatcagaaatggcgagcacctgcactgtagcagaggcagtgggggtggagaggaggcgaatgttcagaggcatttctgagaaatgtaatccacaggaccagatgagctgtttgatgtgaaaaggggcggattttcatttgaaaagggtgccttcgagaactggaagtgacaggtaagcaggaagcgtggctgtgtctacaacatatgaatgttagctcaaggtgggagaccaggctggagcttgccatggcaggaggccaacgcttggggcctgcctagccaagagccagaggctcagatccgggaaccctgaggttgcaggcttgctgactaccctttgcctggggacacatcccctttgttctacctgtggctccttgccagtagtcatctctcatagccctgtagttaggtttggtttttttgtttgttttgtttggggttttgagatagggtctcactctctcgcccagattggagtgcagtgtcgtgatctcagctcaccacaacctccaccgcaggctcaagagattctcctgcctcagcctcccgagtagctgggattacaggtgcacatactacctcccggctaacttttgtatttttagtagtgacaggattttatcatgttggccaggctggtctcaaactccttgacctcaggcgatccacccgcctcggcctcccaaagtggtgggattacaggtatgagctaccgtgcccagcccctgtagttaggttttatctctaatctatataactccctgaagccagaactatgatttatctgtacgttctgagaccctagcctagtgctgacacatatttgatgctcactaataatttctaggtgaatgaattttattaatttcctagataattacagctaccatagcctaattatatctgaatagtcctttggcctcatttttttgtgatagttatatacatttgtatttctataattctacatgcttccattattgctttccaaaattcacatttttgtgaagaagaagagagtaagcaaaagacattccttcctcccagacattaattactgcaagatgcctgtgtaattagtgaaacaggcatctcctacatgtgttaatttagattccaccaaaaagtgcttgattaacaaaaaaatttaaaaattttcaattgaattactttaaaacaaggaataatttccaatttagttatccagacaagttgtatggatccagacagattatttttaaataaggtgttatgggccaggcatggtggctcacacctataatcccagcacttcgggagaccaaggtgggtggatcacctgaggtcaggagtttgaggccagcccggccaacacggagaaaccctgtctctactaaaattacaaaaaattagctgggcgtggtgatgcgtgcctgtaatcccagctacttgggaggctgagtcaggagagtcgcttgaacccaggaggcagaggttgcagtgagctgagattgcaccattgcactccagcctgggcaacaagagcaaaactctgtctcaaaataaacaaataaataaaaaataaagtgttattatcatgtctaaagtatctatttgtctttttcacatatgatgctacatggaataaattagagaagctttactcaagccccaaagtagtcactaccatgaatgataagtaatataaggaagaaaatgtaagacaagtttcttcactgtgtatgtggtttcattctgttcgtggattggatgattcctctttcattaacttttccattttctttgcctttcttgcagataagtgccctctgtgtaccaaaaaggaatgtactgtttatagagacttcaaatcagcagaaaattcaaatagttataacttttctttataatccatcatgaaaaagagtaacgacaagtaagcaaactaatatcagctatttcaatagtttcttttccttttttttctttttgagacagagtctcgacaggatggagtgcagtggtgcaatctcagctcactgcaacctccgcttcccgggttcaagcgattctcctgcctcagcctcctgaataggtgggactacaggtgcatgccaccatgcccagctaatttttgtatttttagtagagatggggtttcaccatgttgaccaagatggtctccatctcttgactcgtgatccgcccacctcgacctcccaaagtgctgggattacaggcgtgagccaccgcgcccgaccttttttttttctttttttaataagtttttgttctgtcacccagactggaatgcagtggtgtagttgtcgctcactgcagcctctaactcctgggctcaagggatcctcctgcctcagccaccccaagtgctgggattacaggcgtgagacactgcacctggcctaaatacaatttccaagcagatatgactgttaacttactttgttgaaccaaaaaaaacgtagctaagatattggcaaaaactaagaaaacatcttttttggattctcatgtctacatttcagcctattatttggaatgaattcctacatgtgcataatgaattgtaccactctaagcctattgactctttgttacttcactgtgtgtgtttcctggatatggctgaattatcctgaaaacctataatttcctgtttccctgatctccaggagactattttatgcttctctactaatatttatgatgtgtatatgttagtctcctgtattgactccactcctgtttatgaccctcttcctgtatacaatacccgtcatacctcattgaccttgcccatcccctagttgtggcttctctgacctgccttcatcttttgctaccccaaatcccgtataacatactgtgtgctaggcttaatgtgctggtcatttgcctgcttgctctcagattcattatttttgtccttctcttactctgtctatgtcacaggaagctgattcctgccaactgcatttcctgggctcatttaaccatgcccagaaggaattaggacaatgaaagataaaaagataaaggagccaacatatcctctcccctttgattcagacgacttctccaccatcaccttcttcacaatggccacttttcctctgcagttggggttcttcttccccagcaatggctccaggactctgttaactcagctcctccccagttctagaggtagacggtagaggcttcctgctattgttactctggggttccccttcttctccagtttggctttccagcccttccaactcctttgtaactagttcctggtatcaaattcacttaactgaactacctgacttcggccctgatgtttgagtggaccccatctcacacactgaggttgacaatacttggcaagttgttaggcgaagagcaaaacaataatcataatcatagaagcattcatgtaggtattgcaaggctcacatctccaaaatgtccagtggagacatgaaataatgaatatgttacatagtgacagtcatttaaaatttttcaaaagccactttcattttgttcttttcttcattctttagtaatcccccatcaatagagaaactatgggggaaaggagcagagtatacaaagaatgatgcccacagtgagcccaaaatagctccaagtggatttgcctgcacgaaagaaagatgtaatcagcacccagagtaggtagcgaaacagtcaacactgctgttcctctcaagacccctgctgctctcccaccagaaacgtagtcgctctctgcattaatttgatcttcccatgacgtgaaagcatcaattataagttgtacgataagtcaagcttattatatgtaagagtccaggccaggcgcagtggctcacgcctgtaatcccagcactttgggaggccaaggcgggtggatcacaaggtcaggacctcgagaccatcctggctaacatggtgaaaccctgtctctactaaacaaaatacaaaaaattagccgggcgtggtggcgggtgcctgtagtcccagctacttgggaggctgaggcaggagaatggcgtcaacccgggaggcagggcttgcagtgagctcagatcacgccactgcactccagcctgggcgacaaagcaagactctgtctc

SEQ ID NO: 6023 - DNA, 1142 bp, Homo sapiens
aggtggcataataaaagaagttctcggtagtgaaaaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattc

SEQ ID NO: 6024 - DNA, 477 bp, Homo sapiens
ggaggggccccgcgcggggccgagaggaaagctggctccggggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggag

SEQ ID NO: 6025 - DNA, 9857 bp, Homo sapiens
actgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggtaattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgtattttgatgtgacaatttctaactcactgtccctaa

SEQ ID NO: 6026 - DNA, 1706 bp, Homo sapiens
cagccagatatccagcactgcaagaggcagcactggacaggaggggacaaataagaggggacagaggtggaaaggctaaatgtccttgaaaagaccttgaaaacacctggtgtaccgcccactgggagacatacacgtggcccctccacttctttctcctgactggctaaagacagctgcgaagtgccatgctaattcacccaggtcttcgctgagtagctggacagtgtgtcatcagtctaattccatcttctgctctaattggctgtgatcaattccacccccatttctaattggttgggttatgcagcaatccagcactgtccatcccaccttttctcccgctctgcgtggcactaggcggcaaaacccgccatctttaacaatgcggcaagcccgccatgatgtccacgtgacaaaagccatgatatacatatgacaacgcctgccatattgtccctgcggcaaaacccaacacgaaaagcacacagcaaagacaaagaggcccgccatgttttacactgcggcaagaccttcagccgccatcttttcctgtgtgaccgcacatgtccaccaccatgctaaccacttaacaaagcctcgcccatcatgatgtggccttcccgccacttgaacactgcgacagaactggatccgccattttggacaacctaacaaagcacagcccgccatgctgagcaatgccgcaatgtcaaaatcgccattttaagccctgcaccttagtctttcctaaccttccatttttaactagtcccttgtactgataaaagatgattcttactgcctcccgatacaacaatcacgcaaagctcctaacaagccccaaatcaattcattcagataggtttagctcatgcaatgcacatgacttcctctgcctgacctgctatcatccatcttgcctccctagtttaacttagcacaaacgactagccctaagccgagttatgcggcaagtctaaaatggcggccacttttcctccacaatctgaacacgcccttagcttaactgcagagtcattctctgccaaagcggtaggtacactcacacaccaccaaatgatcagcagcaaaaaaaagtgtagatattccagagagtgcaacaacccacaaaaccaacattttttcatccataaaaagcaccgatgggcgatgaaaaaaaaaaatcaaagcaggtatccgcggccccgatgggccagaaaaacaaaaattaaagcaggtatccgaggccccgatgggcaaggaaaaataaaaaaaaaaaaacaggtatccgcggccccgatgggcgaataaaaaagaattaaaaggcaggtatccacggccccgttgggcaaagaaaaaataataaaaccaggtatccgcagccccgatgggcaaaatatagaaaagagagtggaagagtaaaaaactgatccacaaaaaacagagatgtcaaccaaaaatgattccaaagaaaaattccttaaatattaaaaattgcctcaaaatattccaaatactttctttaaaaaaatatggaggacgtgtcaagaagacactaggagaaagtatagaatttaaaaaaatattttatggaatttaggtgatttttttaaagaaatacgccataaagggtgttgggggactagaaaatgttctagaaagaaccccaagtgcagagagatcttcagtcaggaagcttccag

SEQ ID NO: 6027 - DNA, 315 bp, Homo sapiens
ctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggtgagcctgggggtccccaccccatttctccctgcctttgcctg

SEQ ID NO: 6028 - DNA, 1114 bp, Homo sapiens
acgcgcgcctccaggagagacgcctccttcttaagtccccggcccctcccgccaacggtcaccgggattcctggaagagacggggatttgggggaaacggagagggttctgcgaggagacgggaccagtgagacaggcaggaccgggtggaggcgtctctacgagcaggagggcaaggaagatggggcaagacgcggggaggctgcagaggaggagcagggtggggtttggagagaatggagcctgcagaaaggagcggcagaaactggcgctggaaggctcaaaaaaggggccctggaaaggacggagcggggacaggaaagggaattccaaggggcaggaggagctgggcagaggagcccgtgtaaacacagagtggcccatgcccaggatgagggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatggcaagagccttgccctcaccccacaccttcccagcctgcttcccctgggacacagccgttgctcacttcctatctggaccccagaggcctcagcctgcatcctcacccagacagagcagttctcaaggatcctccctgtgcc

SEQ ID NO: 6029 - DNA, 982 bp, Homo sapiens
gtttactataaaattccacctaatacaatgaaagagataacataagcttttcatctcctagatttgaagcaattttgtttttttcccttcattttcaaatacagcaaaatattaaggattgacaaaactgagtgataggtacaagtgttagttatattagtctctacacttccccatgtgcttaaaatatttcttaattagaaaaaaaaaagctattgcagaagtctacacaagagccatagcccagggtgctgtaacttgaggaagagagagtggcattgaagagaggacttaaggtgccaccacctggcttgagaagagagacggccatgaggatagcagaagcgtggggatggatgtgggggaaagaggagtgatggtcttctgtctggtgtagctggtgagaaagagggaagaattgaaaacacacagggatgtactgccagtttgactaggagaagcctggtgacgagtgagtgacagtgaaagataagttaggagaatcagtttggggaggaagaaaatgaacttaggtttgcatcttcatgcaactgcaagacagttaaccttaagaagctgctgatgagcatctggagctcaaaagagagatcaggactaggtcacttgctgacccagaggaaagtggtcagaagggctctgatttttagggggatagttttgttcaggtgatgagagaaagaagaggattccaggaaggagtcagagaagctaccagagaggcaaaggacatacgagtattctacaatgtactagtcagggttagctagctgctgtaataaaaaatgttaacaagtttatttctcactcccatcacatggaggttggtgaggaagctctgctctgctccacgcatcactcaggaacccaagtttcttccagctagtggctttcttgtcctttggaatctcagagccctccactgcatcctctatacctatagtcctcgttagtcaagaagctg

SEQ ID NO: 6030 - DNA, 372 bp, Homo sapiens
tttgaccttcagcaaggtcaaagggagtccgaactagtctcaggcttcaacatcgaatacgccgcaggccccttcgccctattcttcatagccgaatacacaaacattattataataaacaccctcaccactacaatcttcctaggaacaacatataacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaa

SEQ ID NO: 6031 - DNA, 593 bp, Homo sapiens
gacacctaagctccattggctccatggcaagtcagctcactgctgagcccaagggaggaccctgaaggtggtcgcacaacaaagacaggcagatgggcagggctgagctcctgccagccaggcatgtgaaggtgtctgcgatggagacagctgtgtaaccttggacaagtcacttaacctccaagactcactttcctccttcatcaagtgctgtgtgaagaatgcaggagagtgatttaagcaaagccccctaactgcctggcgtctagtaagtacacaggcagtgtgtacacaaggaaggaaatggcaggctgttcatatgcagcaagatccacacttggccaaacctggggtcacagagatggacatggaatcgagggcagaagatctgggtttgagtccagcagtgctttaggctgcatcttggggcttctctgaggactcctgtttctaccaatacctacctgttgtggtcctcactttcacagccagatgaaaatggacgttttgacaatggctcacagattcctggagatgtctgggaggaagcagaaagaagcaagaaggcatcaaaacttgaaaagagaaaaacc

SEQ ID NO: 6032 - DNA, 341 bp, Homo sapiens
gttgggtggtggtgaaggctctataggtacacaggaagatggtgacgtaggagaggtcgctgccctggaaggctggcaccaggtgctccaccagcttctccagcgtgccagccttcacggtccgcaccttgcaagtctcataaaggttcagggccgactcattctcatactggggtgggacagaggagggacagacagtcagtggcagcacacgaatctcctggagctcagatggaaccccgagccctcagcagcttgtggcaagaggcaggactgagtatctctagcagaaaaaggttatcagctttaaaagtagaatttcaggccaggtgtggtggctc

SEQ ID NO: 6033 - DNA, 466 bp, Homo sapiens
gctggccaggcagccctgctcacaggcaaggtgtaggggggtatttcctcgaaagtctcggagctcaggatcacagccagctcccagaagtgcctcagcaatttctggctggttggtgatcacagccaagtggagtggagtctacgaatgcaagagagaccagagaaaatagtaggactgaacttctgagaggttaagcgacatggcacagattacacagaagagaaagattttgaagatcagatgaagtagttaccttggaatactgcagaagaaggtatccaaaggtttaggggtattggaatgttagagttatgatgtaaacctgctcactcacccaaggagggtccagagggtacacctttcaccaggactgtcagaaagaaatttgcgagggcacctcagcatcccctaagtactctaactcaaatcatcaaaacagagagtcacagttcctttgtaaaag

SEQ ID NO: 6034 - DNA, 30656 bp, Homo sapiens
gaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagaggaggcctctgccgcgggcactgtgagtcctggccgatgatgacgagaccactgcgcaatctgagttcaggtgatggagtatgttctgagaacagactgaggccgggcaagcaggaggcggccgcggcaggggagaggcggagagcccctcgataccagggctcggagggccgggctgcctagcgagggcttcttttgagtgcgtaggggtggtgggtggcatggacggtttctctgagtcgtcagcgaatgccccccctagaatcctgcttttcaaacactttggtgacactcttgcaatgttggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaatgctcatgtataggccgggcgccgtggctcacgcctgtaatcccagcactttgggaggccgaggtgggcggatcacgaggtcaggagatcgagaccatcctggctaacacggtgaaacctcatctctactaaaaatacaaaaaaattagctgggcgtggtggcgggcgcctgtagtcccagctgctggggaggctgaggcaggagaatggtgtgaacctgggaggcggagcttgcagtgagccgagatcgtgccactgcactccagcctgggtgacagagcaagactccgtctcaaaaaaaaaaaaaaaaaaaatgctcatgtatagagtgttcatttttgtacacagttttctattcagtttgcctctacatatttaagaaaggttaagtatcacaacttcccactgcagatcaccatcagtaggtctttatagatgtactgtgttttctctaattggaaatgtcactaatgagtggattctaacaccattcagtgaaaggtttacatatattaaaacacgtaaatatatgagagaatattgacatagtctccaagtctcatgaagaggaaagggtacctttacaatggataaatcttgcgggtattacttcaccaaattatgaagtaatggtgtcccatcaccaataaagggacagactgacgtcatgcgctccccttgctacagcgacaacacaatctcacttgcgtagaatttctgctgaaaacatctggcctgaatctaattataaggaaacaatgagacaaatccacatggaggtacattccacagaacaactgacctgaactctttaaaaacatcagtgtggtgaaaaacaaaaaatggctaaaataggaatagtatcacattaaaggagactagatatgtgacacatattgtatgagatccttaattaaaacctgggttaaaaaaatactctaaaagacagtattgggacaactggagaaacatataaattatagatgacatggtaatattgacattaagtttcctgatcatgataattatattgtagttatgtagaagattgtcctttgttctaaggaaatacatactgaaatatatgggggtgaagaatcatgagcttgcagatgactggaaaaaatgcatttatatatatacagttatgtgttgcttaaccacgagaatccatcctgaacgatgtgctattaggcgatttcgtcattgtgtgaacatcatagatttcacttacacaaacctcaatggtagagcctactacacacctaggctatatggtacagcctattgctcctaggctacaaacctgtatagcattttactctactgaacactgtaggcagttgtagcaagtagtaagcatttgtgcatctaaacataggaaagatagtgcatgactatacactggcagagaaagataaagcaaatatggccaaatattaccaactggggaatccaaatgaagaatatacagttgttcattattctttttcttttttttttttttgagacagtcttgctttgttgcccaggctggagtgcagtggcatgatctccacttactgcaacctccacctcccaggttcaagtgattttcctgcctcagcctcccgattatctgggattacaggtgcttgccatcctgcccggctaatttttgtatttttagtagagacaggtttcgccatgttggccaggctggtctcaaactcctgacctcaggtgatctgcccacctcggcctcgcaaagtgctggcattagaggcgtgagccactgcacctggcccattattctttttctaagaggggagtcttgcttgctatgttgccagggctggcctcaaactcctgggcttaagggatcctcctgtcccagcctcctgagtagcttgggactacaggcgtgtaccacattcttccatttttgcaacttttctgtaggttttaactctttcaaaatagaagttgggataaaaaatgtccttcacgtaagctacaaaattgcttgaaacaagttatttttgaaaatatttagtccttttcaggtttacatcatgtttaagcagttatgtattcttgtaattttaatatgtatattaaaattgtgataatttttgtctagatgtggagtctttcatgagatgtaaagttattgttctacttttagacatttaactctcagtatttttataaatgcaatattatcatttccttacttattttcctatgcttaaacacagtttctcctgctttcctataacactaaaaattgacggtggcttaagcagcagtggctttagaagtttcagtaatggaaactggggaaagctgacgaagtcagtagggcctaggacaacttttaaaaatgagtatatgaatctgaatgagtgagataagtgaatttgctgatcttgagtagtttggaacgttatgtgtgtgctcactgttaatctaattgctttggaaatacttcaatttttgttaattagaacgcaaatgttgaatgtggttttattcttaaaacaaatactaactcttcagaaagttcaagttgccaagcaagaacatcagatgaatgaaattgttcgcagtggcaaatccgtactggcctgcagcaactcacttcttgcctcctcaaaggaatgaagcataaggcagagtgagagaccgaggcaagtttttgagcaggagtgagagtttattaagaagtattagagcaggaataaaagtaagtaaagtacacttggaagagggccaagtgggcaacttgagagattcagctgtgccacctgacccttgatttggggattgatacattggtacggttctaggccttgcattacttcttccgatttttcccttggggtgggctgtcggcatgctcagtggcctgccggcacttgggaggggtggcatgtgcagtgtgtttactgaagttgtgcacatactcactagagacattcctcccttaccagtcttgttcctagaggaagctcatataccagttaaactctaccattttgcctcttagtgagcatgtttgagcccactctcccaaaatcttatccacaagctgctgatcaccagattctagtattttccatctattgggagaatgcctttccctgacgccagttgagacgaatgattattttagatagtttaacaacttgcctgaccatcacctgatagtcgcttgacattcctgggcggggtgggggaggttttctcctgccctgcccaagtctgcctagctacctattctaagggaatgtagacaggaagtaataaagacaccaatacgccaaactccctcatgttaagtttaccctaagtcttgatgtgttcccagtaaccctaaggcactgtctcaaacttaagatagatatttgtttttcttttttctctacttgtctgaaagttatttgcagcttctatatctttggctcaactttcatttagtagcataaccttaggcaaatcttccttggatctaagtttactctgcaaaatactaatgttggtagaaggagacaatgctgttgttgccttccagccagaaacctccagaaacacacctatagttgaacaagttgggtttaatgttctttggaagaagggagattgcacatcatgggtgtgcctttgggaactgcagcacatctcagtaaaagggtggtaggatttggggtttggttaggtgatttggggaggatccaaggaagtacgggttcactctggattgggtactgtcaggaagtagggacaagtctttgggtatcagtactattcagggttctccagagggacagaactaatagaacatatgtatatatggaagggagtttaagtccaggcctggtggctcacacctgtaatcccagcactttgtgaggccgaggcgggtggatcacgaggtcaagagatcgagaccagcctggccaacatggtgaaaccccgtctcttctaaaaatacaaaaattagctgggcgtggtggcgtgcatctgtagtcccagctacttgggaggctgaggcaggagaatcacttgaacccaggaggcggaggttgcagtgagccaagatggtgccactgcactctagcctggtgacagagcgagactctgtgaccccgtctcaaaaaaaaaaaaaaaaaaaagcaaaagaaagaaaggaagggagggaggtgagggagggagggagtttattaaggagaattgactcacaggatcacaaggtgaagtcgcacaataggccatcagcaggctcagccaggaatggctcagtctgggtccaaaagcctcaaaagtagggaagccaacagtgtagtcttcagtctgtggccaaagggcgcctgagagctcctggcaagccattggtgtaagtccaagggtccaaaggctgaagaacctggagtctgatgtccaagggcaggaggaatggaaggaagcatccagcacaggagaaagatgaaagccagaagactcagcaagccagcttatcccaccttcttccacccactttgttctagctgcgctggcagccaattgcatggtgcccacccacactgagggtggctcttcctctcccaggccaccgactcaaatgttaatttcctctggcaacaacctcacagacctactcagaaacaatactttaccagctatctaggcatccttcaatcaagttgacaactaatattaaccgtcacagtatcatcttatcctgaaggagggctgattagagctaggctcaagctgcacctgggaaagcagctacagtccctcatattacctgggacagggcatatttggtgttacatggtttacacagtgatcttgtttttgtgcctgggcaaaattacagtcttgtttcatatcactttagtgtagtcagagtggccacatctgatattggtgttttataaggttgttcatagcaaaagaacaacacggcccagcacagaggaccaggccagcttctagcatgacccaggcctagctctgagtttcaaatcagttcctggaagtcagtctgcttttctctttctgaactgttattaagtgtatcttgtatgaaatttgcttcttttcaaatgtggttttcctgttgaggctttgaagctaggactaaacctctttgagaatgagctgaaggctttcctcaagtgagggtattctttggtcagccactcaaaaagtgaatccatctttagattggaaggtggtttcaaaagtcaacttttcactgcatagtatacagcaggtccctacataacattgtttcattcattgtcattttgacataatgttggtgagaaaaaaagaattgcttcctggccagggccactgtgtgtgtggagtttgcaggttctccctgttacagtgggtacctagtcaggcatgagcagggcaggagagagctcccccctccacacacacaccaggagcatcttgtgaccatccagtgatggtcaaggcagttgttaactgtctttctaaagtagtcattggtcgcagccagcatcagagaaaggcagtctcccgatagaaaacacatgaaactggtgatcagccacttcctgacaagatctcaggagttgagagaagtaacacaagaccgcagaagtaggccaacatataaaaccccaagtcaagaggttaagccacgctcttgactctttcaagtcacccacttggccctcttccaagtgtactttcctgcctttccactcctattctaaaacttgccttggtctctccttctgctgtacggccctcaaattctttcttctgaggtggcaagaattgaggctgcagcctcattcatacagacatggatacgttccactggtgagatccccatgactgttttctttggattctcatttcctcccatgtcctaaagctgtgtacatgaggtgaatggatgtgtctaagtgatcccagtctgagtgtgggtttgtgagcacacccagtgacaggatggtttcctgtccaggcctggtgcctccctggcaccctgagctgccaggagaggtgggccctcagtgactcttaaatggaataagtgggcaactttctcatttgtttttattaatctttctcaaatgtatatatagctttcatttcagtgtttaattctagaagtgttttggtctttatttagaagtttgttgatgttttggccgggcatggtggctcatacctctaatcccagcactttgggaggccgaggcaggcagatcactgggggctaggagtttgagaccagccgggacagcatagtgaaaccccatctctataaaaatacaaaaaaattagccaggcatggtggcggacgcctgtaatcccagttactcgggaggctgaggaggaagaatcacttaaacccaggaggcagaggttgcagtgagctgagatcttgccattgccctccagcctgagcaacagagcaagactccatctcaaaaaaaaaaaaatttggtgatgtttgtatgaccataaatatgccgaaggaactgtttatatcaactagcttatgttaaaattggtgtcattacgtcattttgtttatactcgtggtttcctagaacttatcagtgacgttgaggactaattatactgtgaccatttttctggatcatgaaatatttcaatagtggtctctaatgatgggtgcttaagggcaccatccctggggatgtcttcttgtatatttttaggtgggtcaggttaacaatgggtgtggaagggcaccatctctggaggtgtcttattccataaatttgggtgtaaatttttttaaagatttccaggtgattttgatgtgtactcccagttaagaaaaaatgtatcagtatttccatatagatgctcagtttctgggctattctgttccactggtcaatttttccacatccagggccgggcgcggtggctcacgcctataatcccagcactttgggaggccgaggcgggtggattacctgaggtcgggagtttgagaccagcctgacagacatggagaaaccttgtctctactaaaaatacaaaattagctgggcatggtggcacatacctataatcccagctactagggaggctgaggcaggagaattgcttgaacctgggaggcggaggttgcggtgagctgagattgtgccattgcactccagcctgggcaacaaaagcgaaactctgtttcaaaaaaaaaaaaaaaatttccatgtctgtcatcctcacacatcttaattactgaaattttgtaagtctcaatgcctgctaaggaaagcttcccactttctcaaggagggtcttccttattcatgggcctttgctcttccatataaatcttataatgagcttgtcagttttcacatagaaacagttgaaattttgatttttaatctatagatcaacttggggacaactgacaaacttttagtggtatggagtcttcgaattcttgtacctaattatttctccattttaatgttgtcattgtttttcacttatattttacaaattcctccatacagatcttatgactatttccccactgatttttcatgccatctctaccgtatgctatgttatacataggattgggcctatccttgcactccctattctgtttcgttgatctacttgtctttgcctacaccaaaactgcctttaattccatagctttaaagtaattgctcaataagccttgttatctgagagtttctccctgcccccaacttttggactgtaagatgctgacctctggtttaaatgatcttgacacgtattagaatataggccccataatgaagcttctcaagagagcattacaaagaaactttgtcaacctgtagctgcagagttttaaatttcatttagatttggcacacctctttattcaaaagtatttatttccacaaatttttatccacagctaaatattacagtgactattacaagcatttttctataaacaaaggtgtagtttacagatttgtgcaaagtgggaaaatattttcatcagtagtctttcttccatggtgttggattcacccctgaatatgatctgaactctttcagagaggcagtccttcatctaaatgtcagttggtggcaaaatgttatattcaaatctggattattctgatacagtgtcactttagaaagtagcttagtttcatttctgattgatcccctttgttagaattagaaattttttgaaaaacaatcttttgtatctaatgacctttataataaaaaaaaccctgtcctgtgtttctcattggcattaacctctgtctacaccctctaattctctaattatggcaccagtgggtataaaaagtgaattatggttatttggctcatgcagcaaattaattggagaaactgaccacaaatattctgtgaagaactacaaggtcttgccccatgctgtcccattttagtgaccatttagttatgcaggcattatacaaatgcctcaatttaggacacccttgctgtcttagtaggtcaagtgtatgaaaatttactttatgcagaagaaatgaattctaatttattggttactggaatcttaatgtatgaaagctctaagtaaatatttgatgaattgatggtagcagtgttgatttttaactgttccaagctcctagttttgttttgtttttacaaaagccttaaaatttagtactagggaaatcaaaggaagcaactcccactgacatgcttcatggaaaggggaaaaacatctacctttgggtctaatctgcctcccaggtgagcctacaggtactggaactctaactgcaactatgagggcacagggaaaatgcatgtatgtaatatgcttgtcagcttcagcaacaactcatgtgtacattcacatttactataagtaaacaggtcccgtataatacttaaaacacaagttttgatctataaatatttgattcttaatatttaaaatgcttctaatgttttaaaagacaaaactcccccatgatatcaccttgaacattaaaattattcccacagcaacacttatttcagagaaacaactgatgtcagttatcttagtaaccgctaaaggcacctggtgaaaaaaatgtcaactaaattttaaatattaaaaaattaaagagacatctaatgcagagttcaaacctgaattgttaaagagtcattactgatttcatgacactgataaatgtttgaattgaaatgattttttaaaatgcagagaaaatgctaacaaaagattatatagttcccctaaagatgcttcttctagcctccaagtattaaataagacagatctaaatattaactacatataaagtatatatttgttagtcatctgtaagttttaagtacaattccaggatatacctttatcttttggaagagaagaactaaatctgccatttcttaggctaaatggactattcataaggtccttccctccccatttattctaattgccaagcttttattcagtaagctcttggcacctagtgattaaccagtgacagcagagagtagtgaccaagagagatggagagaatgatggtataagacagtgtataaggatagtaagccactgtgtttgtggaaccactgcatgtcaaaactccttaacactctaacaaggcatttttggtcttttaaggatggtccttacataagagactcactttcaaactaaagtgcattaaaaaacaaattatccttcacaaacaactttaaagaggtagccacaaacccagttgttttagattggccttctaaatgaagtcagcacatggatccatgggtaagtgtcatggacgtcagtgattatgtaactgtaactgaaagaaaaaggcacagctctgccgatgcccaagagaagccggcatgtttaatgtggatgtagaggggataatgcccatgacaactgattggaacacaatgtcagcagccttaacccaggctaagactggcctaagccccaggagatgcagagaacaactgaggaagctgtgctctaagggcacagtgcagaaggtagcgtggagtgtgctgtgtttccaagagccttttaagttgggtggttgagtaaaagagggtgaaggcaggctgttctacttccaattcatggataaatcttattttctcaatgtaatacagaggctgttcttccatgatttgcaaataccatttttttcttatgggaacagcatactgctatcaagaaatacagaaaagacagtaaaaaaaagtgtggaaagaatatgggtttccaattgaatgcttgcttttgaagaaaccaaaaacaagttaaaaaaaattctaagagcagcaaacatctaagcctgttatattactgaattacttttttaaaatccttattttgtgggagagatatttacaattttttgtgtgctaaatttgaaaaacgttgaaaataacctgaaaagggaaagttgacctaagccattttattctcttaaaaaaaaaaaacccaaacttttgtataatatccctgaactgattatttttgaaggtttttcagatgatctgatgtgcgaactttagtttgttttactatttggtttctggaacagtagagcattatgtgatgctcttactggaagcttaatggtattaagagattaaaagctttcatattgacttgtttggtttttacatctataaataaaacaagtttgttatccgtttctaatatttagcttatatacatttttgtgaaagttttgtgggacttggaaagtgtatggactagcatcagaaacaaaatatttttccatctttctcacttggagtttgggatagcagcattttaataatctcttccattaaatcaagataacacaaaagcgtttgagcacactgaggactggcacttctaattttgcttcagaaaccagtactcaaaatgtctggtctggaggtcagttacaccactgtctgtgtataatcagccattaaaaaatattttgggaatatttctcagaagtctcatccccatatttttgttcttaaaacatctcaccacaaactcaaccacacctatggtttgcaaactttgggaaatgtcagtatatgccattatcatggttattagtaccattatttgttaaagccctttgaaggcaatttatgtgacttatatatatttggtattttaatttggacattctctagttctatgcaaagatcaaaactaggcagcttcgttttatagaattgacaccttttatatgtctatggggactgcttggtgtctataaattatgtatatgtgttggactgaaatcaaacttaaaatcttccatatttcaagtgtttttattctgagcagtaggtacaaaaaataatgacatagttgtgtctaattctgtatagttcagcaccctccacaggctgtcaatctctgatttgatctacttttaccagatttaacagatccttgaatttactttactgtatatacttccttcttgctcacattgggaatcaaactaatgctggaaacatgcatcttcagacttcattgaggaattccagattgagacacgctgggatgtggattgagtccatggttagagaagatggattaaatggaaacaaaacaggaaacatgtgcttggcatctaatagcagttgctgagggtcattccgctcttgtagttgtgcctatggggaagaataagaccatgtaaagtttgagtacccctaaaaatagccagtttaagtgaattcacaaaagtgagttggcatatatcatggaaagatttctacgacaattaggtagaacttcaggactaggagaatgtgatctcctcacccttgaggtatttagtggggagagaagccctgacttaggcttcttggagatcagagggctgtaagcactctcccaattctagcattctttaaaaaattgtctaagggagaatataaaatacatctcaggtgcaaaccatatggagaggcactatagtgaagtggccaagggcatgggtttttttttttaggtagacagctgagctctaatcctggcaccaccctgggcaaattcctgaattttttatgcctcagtttctttacctgtagaatgggagaagagtacatcacataaaatggcagagtaggaagccctagggattggtccctccactgaagctaccttgaagtagaaacagtgattgtcaactatctcataactctggaacttgattggacatttataacaatcgggagactgattggtaaagggagaggctgctgatctttgctaagggaactgtgtgtgtgacccagctactatccccctctcttcagctcccctgaagctatggggatagcagctcacattcctggagtagctagctggccagggtaggcagtgggaccttgtcctccaaaaatttggggttgtgccctttgatctggtgggtcccagcagatgcctgtcttggtttagacattccttgggatgcaatggcttccactagtggcatcaactggaaaatttaaaggcacagagcccctccctgcttcctatttgaagccagaaattttaggaaaagtacaaaaactgaaatgaaaaattcactagagaagtttaaccgcagacttgagcaggcagaagaaaatcagtgaatttgaagataaagcaattgaaatgatccagtctgagaagaaaataaaaataatgaggtaaaaatgaacagagcctaacagacctattggacaccatcaagtataccaacatacacattacaggagtaccagaaggaaaagagcaagaagggggcaacaaaatatttgaagaaataatgccagaaacttcccaaatctgatgaaagacatgtatgtaatcatccaaaaagttcaatgaactccaagcaggataaaggcaaagagattcacagtgaaacacattatactaaattgtcaaaaccctaagacaaagagggagtcttgaaggcagtgagaaagaagtgacttgtcacatacagtcatccctcagtatccatgggggattggttccaggaattcccacagatacccagatccatggatatgcaagtactgctgtcggccctgtagaacctatagatagaaaaagttgtccctccataactacaggttctgcatcctgtgaatactgaattttgaatctgtggttggctgaatctgcagatatggaacctgtggatatggagggctgactgtataaggtatcctcaaataagattaacagctgtttttcatcagaaaccatggaggctaggaggcagtgggatgacacagctcaaatcctgaaaggaaaaaatcttgtctgctaagaattctaaatctggcaaaactacccttcaagaatgaaggagaaattaagtcatttccagagacaaagaaggacattatattttaataaaaggttcaactcatcaagaagatataataaacatctgcatctagcaacagaaccccaaaatatttgaagggagaattgacagactttaagggaggatagttctacagtaatggttggacatttcaataccccatttttaatcatggatagaaccagatagaagatcaataagaaaatagaggccatgaacaacactataaaccaattagtcctaacaaacacatatggaacaccccacttagcagcatacacattcttctcaatgcatatggaacagtctccaatattcaaacaagtctgaataaatttaaaaatattaaagccatatgaaatattttttctgattaggatggaatgaaactataaatcaataaatgaaagctgcaaaatccacaaatatatggaaaataataagttctcaaatagccaatgggctaaagaaatcacagggggaattaggcaataaaaatataataaaccaaagcttatgggatgggataaacatagtgctaaaaagtttgtagctgtaaatgtctacattaaaaaaaaaaatctcaaatcaataacctaactgtataccttaaggaatcagaaaaagagcaaactaaacctaaacctagaagaaatgaaataacataaattagatggaaaaaatagagaacagatcaatacccaaaacaaatgaaatcaaagttggttcaaaaaattgacaattttttttttttttttaagatggggtcttgctctgtcacccaggctggagtgcagtggtgtgatctctgctcacaatctccgcctcccaggttcaagtgattctcctgcctcagccccccaagtagctgggattacaggtgtgtgggaagactaaaatgagaaattagcaaatcagaaatgaaagtgaggacattactgccaattttacagaaataaaaaggattataagagaatactatgaaaaatttaacaccaacaaattggataacctagatgaaatggacaaaatcccaggaacacacaaactaccaaaactgatttaagaagaaatagaaaatttgaatagacctataacaagtaagcatattgaattagtaattaaatatttcccaacaaaggaaagcccaagatgggcttcactggtgaagactatcaaacatttaaagaagaattaacaccagttctcaaactcttcctaaaaatcaaagaggaaggcacactttaactcattctatgaggccagtataaccctaatatcaaagccagataaagaccctgtaagaaaacaaaactatattcatcccttataaatacagatgtaaaagccctcaagaaaatactagcaaactgaattcagtaaaaggttaaaaggattatacaccatgaccaagcaagatttaccttcagaaagcaaggttagttcaacataaaaatcaatcaatgtaatataccacattaacagaatgaagaggaaaaaacccacatcatctcaatcgatggagaaaagcatttgccaaaatccaacttttttaatgataaaaagataaatccctccatgatgaagaccatatgtaaaaaccccacatttaacatcacaaatatcacactcagaaagtttttcctctaagatcaagaataagataaggatgcctgttcttaccacttctattcagtatagttctagccagggcaattatacaagaaaagagataagaggcagccaatttaaaatgatcctcttgcagacaacatatcttacatgtagaaaaactgaaagaatccacacacacacacacacacacacacaaatattgctagagctaatgaattcagcgaagtacataataaaaaaaaacacataaaaatcagttgtatttctattcactagtaatgaataatcagaaagaaaaacaattccatttacaataacatcaaaaagaataaaatacttaggaataaatctagccaagaaggtgcaacacttctgaaaaagtcaagacctaaacaaatggaaagacaccccatgttcatgtactagaagacttaagatgacaatactacataagcaatctacagattcagtgcaatccctatcaaaatcccaatgacgttttttgcagaaatctaaaaaaatcctaaaattcatatcaaacttcaagggatcttgactagccaaagcaatcctgaaaaataacaaaattggccaggtgcaatggctcatgcctgcaatcccagcactttgggaagctgaggtgggcagatcacctgaggttgggagtttgagaccaacctggcaaacatggtgaagccccttccctactaaaaacgcaaaaattagccaggcatggtggtgcatgcctatattccctgaggcaggagaattgcttgaacctgggaggcggaggttgcagtgagccaagattgcactactgcgctccatgggtgatagagtgagactctgtctcaaaaaaaaaaaaaaaaaaaaaaaggaaaacaaaattggaggactcacacttcccatttgaaaactttttacaaagctatgggaatcaaaacagtatggtactggtatacggacagacatacagaccaatagaatataagggcccagaaaaaaaaaaaaccctcatatttttggtcaattgatttttgacaagggtgccaagtccattcaatgagggaaagggcagtgtctttgacaaatggtgctgagacaactggatatccacatacagaagaatgaagtgggacattcaccttataccatatacaaaaattaactctgaatggatcaaaaacttaaagggagctaaatctgcaaagctcttagaaaacataggggaaagtatttatggttcttaaaaatgacatcaagagcataggaaacaaaaaaatatacatagattggacatcctcaaaatttaaaactcctgcatcaaaggacactatcaagaaagtgaaaagacaacccacagaatgggagaaaatacttgcaaatcatatctgataaggatttaatatccagattatacaaataactcctacaactcaatatcaaaaagacaataatctaatttaaaaatgaattaaatactggaatagatatttctccagagaagatatatacatggccaataggcacacgaaaagatgctagtcatcagagagatacaaatccaaaccacaatgagatgccacttcacacccattaagatggctataattttaaaaagctggaaaatcacaagtgttggtgaggatgtggggaaactggaactctcatgcattgctggtgggaatgtaaaatggtatagctgctgtggaaaagtttcagattcctcaaaaagttaaatatagagttaccatatgacccagtaattctgcctctaaatatatgccccaaagaactgaaaaattgatctcagctccttgtgcaacaatgttcatagcggcatgattcccaatagccaaaaggtagaaacagtgcagtttccatcaaccaatgaatagacagaatgggatatataaagggaatattagtcactaaaaaaatgaagtttttatgcatgctacaacatggatgacctttgagaacctaagtgaaataagccagacccgaaagaatatcgtatgagccaacttatatgtgatatctagaatttacatatagaagcctacccagggttgaagggaagggagaatattatttgcccaaatgggtagtgtttctgtttaggatgatgaaagaattttggaaatagtggtgatggttatgtaatattgtgaatatacttaatgccacggaactatacacttaaaaatggttaaaatggaacacacataccccaaaaccatgggatggagaagagtacccttctgataaggttgtgaggatttgaagagttaacaggtgtaaagaacacagagtaccatcactggcacatagtaagtgctgtatttgctgttatcagttttataatatgctcctttgttcctcctgcccatgcattaaccattgacctctgaaccatgaactgctggtagaagctgtacttttacaaaagtcaatagggttaactgtgggagtattgccaaaaaggaaaatcaatatatcctgattttgtgaaaacacaatttatttttcttaaacctcgaaacaggccatagtcagtaaatacatagcagcatttgaaaatcgctgggaaataggtttacagaatgaagtcagctggagcatggcactgtaagatggctctatagtggcaggggaacctagaattgcccacgttttcatccattacctgaattatgaatagaaagcatgacttaaatttccagtacccgtgtgtttggcatcttgaaagatgggccaaaattttaaagtaattttaatcatttgaaaaagtggtttgaaataatgggagagaagtttaaaggagagaaaggtatttagggaggaataagcaactagcctcactaattcaaggtactcaatgatggctctggtgtggcctggcagaatgattctctgggattgttgacagctcacacacagcccactctgaggtttgctgcgtttattatcatgaacctatcacaaggcatatgtatgtaaaatgtgaaatggcaggaggctctgggaaaaaaagtcatctttgtagcacttaagggcccttgtatttctccacattagttagatgtgacagtagacttcactacctaaagggtttgaagaaattttagagagtataaaaatgggaaaagaaagtgaaatattacctatattatcacaattcaacagcaaaaggcatgtatacttttaatcaattaaagtatataaggtggtcatttcacagaaatcctcctgtgaatgctttggtgagtttaacaacttcaaatttacatttttaaaggtcagtacaaagctataaaaagcccagagcgcccaagcaatggtttgctttaacaagtaacttgtctttatcacacatgtgagttcaaatgtaggagggcaggactgattgttcaccatttcttctgagcattgtataggtagaaacaacataaagctatagctcatgaaaaaaatattttgctagaactgcgagacactgaaattgattactgaggaagattcagaatctgactgtacatattttgagagaatagttgggcttaacctccattatattttccctttgtccttgatccattaaacctgcagtatgatgtggcatatattttttaacctgaattctcataaacagtggggttgccaatttatgagcagttatagttctccctctaatgtgtgtctcagatattcgaaactaaacaagactttctaaacttgcacttttgtataaattatcagccctccataaaaatccatataatgggtccaggttcagatatctcagtggcttctgtcatcaaactcttcccattcagcagctgactatgagcatcctaactggatcctttctgtcagcgccacccacaaccccattgttgtatacatgttggtgagtagagagactcactctgcctgccccattctgcggcctgtgtctttaacaatcgactgtgtttctgtcattgcccttaggagaacaacctttagtctgactaggcaccacttcccagacgttccctctgttggcctctgttccctacttagatgctgggctaaagttcatttaggctttttttttgccatggctcttttcaaacccctttttagctcttttcagggctctctaaatctctggatctacattgaaacactgtaaggagctccaaataaaatcccaggagtattccaaagggaacaggttcttgtacaaagctccatgtttcctcacgtttcttcagtgtctttgataaacctccatttggttccctttttcctgactctccctctgatgacttccccctgaacccctttttaatccttgttttgtgtcaatatcccttcactggccaacaaggtcatttaaaagtttgagggagtgctatgtctcccctgaggtgctccccacaggtaatcatgggagaagtgtggcctgttttctgaatcactgcgacatgactatcattccaacactgtcacagttactatcacatgcaaaggtcaggcgctcagccatcaccttgggctcagcttaaggaagctcatgtttaagtaaaacattcccatcatcttaggaaaagacagatttaaataaccgttttccctaatacattttctttcaagcattttcctaaaagcaaatattgtcttttttttttgagacaagagtctcactctgtcgcccaggctggagttcagtggcgcaatctcggctcactgcaagctccgcctcccaggttcacgccattctcctgcctcagcctcccgagtagctgggactacaggcgcccaccaccacgcccggctaattttttgtatttttagtagagaccgggtttcaccgtgttagccaggatggtcttgatctcctgacctcgtgatccacccacctcggcctcccaaagtgctgggattacaggagtgagccaccgcacctggcctatattataagtcttagacaaagatttaagagctcaaattgctttctttaaagaacatttcttagttccatttatggttagggctgatattctgctgacattgttaattccatttggtgctaatagttcagtaacatgctagtggcaaatgacataatgcttaaactatgtctataatctgagaggcagagatgataaaagttgagttttctgtgtgtaaacagtaagttactcatgggtgatacggttcatgtttacctaagtagaaagtctaggaatgtaaggtctcccagcatatatgtaaccagtattttagtaataaagagaagcaagattaaagcccaaatttttaatttcctttatagtcgtagactggactttataaaattactatcttaaaactcacctggattgttcgtataaaggccactgttacccgttcttcaaattcattcaggggagtataaaggtttaaaattttgacaatctgttggggataaaaacggaatttagcacagagctaaatgaacatgagacaacttttgaactttaaagaatatgtgacattggtacaagagtatgatcctctttagacaaggcccacaacacagatggagctggactgacatttacacttggagcctgcatccaggaaactagagcccacagctttgtcaggtggatctgagccctctcaccgaactcatgtctcctgtaaacccacctgcccctccccactatgctcattggtatacacaatgaggagtttagaatgcagttgcctgaaatcctcagcctcatatctactagtaatttaaaggtttcttctgaagagtactggagatcttaccttagatgagaaaggtcttgtttaatacctaactaccccctgtcccccaacattgtttacaaatgagtatttgaacaggagatactcttttgtctgcctaccactggtttggtggaagtagactgcccaaatgcaatgccagctgcatctagaaggaaacttactttaagtgaaatgtatttaaagagaagaaaaatgtttgaagactttctggaaatgtttacagaaggaagcagttttttaaagagttagatatttaatattttaatagtaagcagaggaggtaaggaaaggtgttcactttgctatattaagatgtgtttttctgtactgagtttggattttgttatttatctttcagggactggcaatgtgtcggcaactgaatcatggttatacattttttagggaaaaggaaagtaacacttaaatgcccctaagttcttaatgacttcatttaaaacaatataaatgagtgtgagtgaaaatatgaccatattgcaattagttttaaagaaaaggtttttcttacagttatatttgtaaagaaagcaaatacctgatgctgccaatttctgaaaatttgtggatttctatgtaagaaacattccagaattcattatatttaaagaagtttttacctaaacttaacgttttgtgagtttgctaccttatctttttaagtgagtaagagggatagagagttactagaaaacagtatctgtggcatcttgtttcacagaccaaatggtttttggttcatctaggaatatcccatcagctgcacttcaaaattgtctcattaggggtatataaagggtgggagtgcaacactaacaaataaccaccaacgagaacagacttggaatggactcagggcttccttggaataccatgttgacagaggtgcaaagtgactgtacctgctgggtgctgagggaggtacacagggagcagatagcctctgcgtcctcctgggttttcttctttaattgcaggagctgggctgcttggatcagaggttccatggtctgaactgctccactctggtgaaggtttcttccccgaagccactcctcaagctgacttatattgtaccttagccataggtagaaagcaagctatgttaagccggtcctcctaattcactgagaaggggacacctgttgtgttttgcaggcccgctgcagctagtgccattatttatctcacacggttaaaaagcatggcaagtgccttgcactcaggaactatttgttgaataaagaatgaataaatgaatgagtgggtacttaaaatcaagcaaagatgaaatacctgaagtgtctacataagttaacagggaaaaacaggcattaaatatactgaattgtaagtatttatatttaacattcacaaatgtatttatacttctatgtgagccttcatgcctcttaactcattgagttttctctctgacctatctgctttgtattcagtctttaacttagagtatgtcaacatctttaagctttgaactaatttgtttaccaagtcaaccatctcagtgttcgacggatttcaccaacaggtaaaaaggtgatggatttgagtcacagactgatggagacaaggactgtcaattagatttggatttcatttttagaaacagcagtcttgtgttctgattctagctgcagtcagtgagggcccactctatctgtgttgttggggggtgctcctcccttacctgagttgcatgcctgtgctccaagagcagacgtccttccgcaagagcaggttgttaagagtcactgcgttgatcatgtagaagagctgtttgaatacctgcaggatgatctcagggtccaagccctggtcacacatgactgtatgaaaggcattcatctggcggatgatagcttccaggcagtatgagttatccccatctgccatgctggaggagcgcttccggtagccggtgggcttcacaccagatagaccctgaatgctctcattttccaacatggcagaaactgaaataaaagcacagttagagaagcttgcattccccactaacaatgcaaagattggaccactcaaatcatttagtgctccgggctttagcaatgataccatccagaggtgtgcaatgttgacatgcttaggaacttataacatttggcaaaaaatttctaatgtgttgatttctgtatggaataaaacagctgtggacagcattttcatttaatttactggcaattagacaaagatgatgggcatgtaccagctcgatttggtatcgcctgtgctgaagtccacagtttgagaattgagcaacctgggtgtcatcctcgtccagccactgactatgtaaataagagcttcattggtccgtcatacttactaagcagccattacctatgcaccaggggctttatgttcagtatctctttcaatcttccaacaactctataaagtactacccatttttatgaggaagttgaggtataaagcggttaaataacttgtctgaggtcacactgatagggagtggcagggccaggatttaaacccaagtctgtctgactccagaactgctgctattaaccttcacattattctgagtatctccagcttgatatgtcagttctccctctgtctggtgccttataaaaagatttccagacaggaaggagggtttggaatgaacctcatttcaagtaatgtatttctagattggtccttcttgggattcactcataacctacttgtgttgtaagaacctggggaaagcattatgaataggtccaggtacactttccttcccagcctttgcagagcacagtgagtaatgcatctacacataatttttcttccgattgaaaatgtaactgctctcatttctcaattctgatttcatgttcagtgcccaagtacactgcttggttcaaagcaagtgtctaataaatactgatgcatcgtgccgactgctgtgtcctttcgcatgaacactcctgcttttttccatgaatcaagttcataataggttaagagggttatgctttttcactgtatatgcatttgtaccttttgagtttacatttattatgtattaaaatttgggaaaaaatacaacatattacagaaaaagagataaagggaaagtcatctatgcctcttgcactgtgtcaaatactttcacagctttttaagcatgatgtgcacacctcagttctgccttcactggaaggttctggctttctggaggtcatggctaagatatctggttcccgaaaggcagagggtgctgaccacgccttcccctcatttcagacaccatgatgagtgatgtagctctcctgctgccagcttacctatcatcggctgtaacacgccctcggcaattttaatgagctgctggtagatctgaatggaaaggtcactcagcacctgacggtattcgcaggccatcaaatgaagtgctggttcttaggagagagatggcgtcaagccaactgcaaagaaggtaagactgaaaggaagggcatatccttttactaacccagggagaagagtctgtcaaaattggttctggcacaaaagatggaataaagctttaaaaatggtcgcactattttggtttacactatgtcttgaccttgggaagggtggatggtgagatatgtgaaaggaaggggaagaaaagttggaagacctacaggaacctgtgagcgggcatatctggaacaagctgggattctcaccagagaaactagaatggaaacaagccacatattactaggtcattgggcagagtgcagagcatgggagaagttctttcagggaccaaagctaggaatgtgagttccagaaaaagctgggccttacaggtccggtgtggattgtgaagtgatggggttagtagttgggcctcaggtcaaggaatccaatttggataaatgcatggagctgggcctccaggtcagtttgcacacacgtagttctgattatggtgtgcctctgttcttgtggccatctttgtctatcttgaaatggacagattaatcagttggcttaggagacagggtgacccactaggcaactgagctccctgccagtatccactgcagtggggcttctagagctgatacagaaatgtcaggttacaagagtttcatggagactcccagggcctctattgatcatgggttatgcagactctacttacataacccaggagtgctttttggggccccttgggctcatcaaggcctcctagaggcaggtctcctgtggctggccttattgctgcttccagccacgaggcatgataaggtgtgcccacggtctgaggtccccaagggtgctccaaagaccccactgacctctgagggtatacaaagcacttctcaaccacatttggatgaagcaggaatgcctcctgggtgcctggctccccactcacctcatccccgctgtactgcttcagacagtgaagaaggcggcaggtgttggataaccagaatgacgtcatctcaaagtcatcattgtgcttctgtgaaaagaaaaggacatcctcagctctaagtggctcccatctggtgaaatgcttcctcggtacctctttccccacatttcctacccttacctagtgttcctgagcagccctgaggctgggcagggcacttgccagtcacggggttgagacccattgctgagaggctgtgtgagtgttcctctaccaccagggatggtgcacagaacccccaccttggtctcctgatcagtggtgcacatacagggacacacataaaggacaggctgccttccatggctgaagaatgaatgcaaagctgagtgacagatgaggctctgccccaacagccccgggctctcgtctaaccgcctgggctagctggctctgtttctgaactgccagttatccaacacaagggatgctgaagagcataacagcaaaatagtttggtgtcccatttatctagatgtcagatgcatcatggctttaactctctagaaaatggctacaaaccctaactaggtgaaaaagcctgctcagcaacccaaacagctatgagacagctgctgcattaaagctgatgacttcacgcagctcattctgtcaagtaagcgttatcattatttaaatgacagagtggtatgaggtacgaccaaaagaaaaaaaaaaaaaaagaaatgaggttgaatagaaagtgactgctggggctgggacatgctattttagctcagaattagggaaggctttcctaaggaagtgacatttgtgtcagccctaaattggcctagactggccgaagattccagctggatggtgctcacgaaagaggatcaaggctggagacacaaatctgagagccacgagcatgcagatatgttttagagccgtgagtggataaaattgcctgtggagggcaatgcagctactgagggcaggaaaccagacttaaaggctggctctggaattctgagcagcaaccagcagctcagtggactccagaattggtttggactcagagcttttgagaatggcttgtatcctggaagcagtaatgtgtaagaactaaagatggtctctaagagcaataatactcggggcacaggcctgctagcaggtagaaatccctctcactgagggttcatctccctcaagaatctcacctcccccactgcctggccctcatccatgtgtggacaggcctcaccctccctgcaggccagcctgtttctgcagtggctgcactacattcaagaagagccttgtgccttcaggtggcattcccgagcacctttaacaccatgcggcaagccctgtcctggcccaggttgcctcaccttgggaggtgatggaatgtcacagccctccctgtgttaccccccagggaagcaagcacccggccccttggaaaggtggagagggcccatgtttcaggggtgtccctgaacttgctccagggtgaggcccacacacccttggctgcagcaggatgtctccctagcacctctggcagtgggcaggccaaggcttctgtaagcactgggcatgtctggaggctcagcagggaggagctggagggctacctacaccagagtcctcggctttctgccattgctgggcctgagcatccttctctgggaactgccaggcatcctggttatatggatgcttctgtggctcatttaccttcaaagttggagccctaggagcattcactacagccaaacccagacacagagaagcaacagtaaggggctggcttcactctacccaccacaaaccatgaccttctgcaggggctgcttactttcaggactttcttaatgccgttgatggtggaggtcagcagggagtgcaccttgagatcgtcgttggtgtagtccgcgtgccggatgcacatgtagaggatgtaggcggggagacagggcactgtgcccgacagcatctggggcttcaagtctaagggcaacgagagcagcaaatggcaagttagatctatgggggacaatggaggctgtcagaatcctcatctgaatagacgtgttttcaatatttccccatagctcatctaggaatagatgtctcaaagaggattgggagagaagccacccagggtacccaaactcccgagcatgcctaccagtagtttcagacactgtggttaaaaacacaaacaaacaaaaccacattcctaattgtctgcactataaccctgaaacaggcttctaatgcctcagcctaacaatatggaggaaaagtgcctgcaagttacacagatgcctcagtccgcagccaacaggggcccatggcaagtggaaggctgaggacagggcctagctcccacatgggggcaggaactcctgattcgtgggcaccaccacttccagaaggcaagggctggctccagaattagacaaattgtatgtgcccaaagacagggccagcctgctgagggctagggaggttggaacaatctctggcccatcagttcaggaacaaattacccagccgtgcttgcccagcttcacagccaaatagatcaggcaggccccccttccccaccccggtgctgctgcttggcatgcatctctccagcggctctcttacttcccccaactgctctcctctgtatcccacactcctgtccctgcctgggcaagggctgctctggctggactggaagggccttgtgagtctccccattaactgcagactcagccctttggccctttcttgcaaaaggccctggagggacaggaagcagctgtcagaccattttctattccagaccatgccagctgagccagacttaaggcaacaggtggtggtagaaggccagagaactagggggaaaggcctggtgcaaaggcaagatgacaggtgagaatggggcaggagcacaaggccccaggggtctcaccatagctctgcactgtatctccagcccttgttctttacactcataccctcccaaacgaggcctcatgagccacctgtaggctcagaatggcaatgaagggaggccacctccctcccacctgcaggtgggcagtatccttgcaaaccttctaccaggctggtcctgggctgggctctgctgccagcagctccagttggtacttgggttacattgtccctgctccaacgcatccttctagttaaatgataactgtaggccataatactcttgagtacatggttgacatttggccattttataggtccagcagatggctgtggattggccattggctctagttagaatgccagtcatttatccaggaaaatgtattttgtaggcccagacttccaatccataacttcttacttcaaacctgatccatgtgcagattgcaaacaacttgtcctgtcttggaatgttctattgtgattaaataaagcttgtttgggtgccccagctaaatgttagcatcttggggaagagacgatgacactagttttatttctcctccacagcaactggccagtgccaggtacctaagaggtaggtggtcggcagtcaagttttggcatttgtttggatggggtcttttggagggaagatgactgcaggattttcctaggtagctcagcaggagatgacctttcctggggccacctgagcaagggtcatctcatgctgatggcagggttttctctgtaaaaaccctggcaaatggcaggagggagccacctgtctgacacaagcagccttatttattgaaagtttcattcaccagagatgaaaggtttgttcctaattgcatttgaacaagatgcagtctgtttaaggaagtttaagataaacttacaccacatttaattaattgctggacaactgtaggggagattaagctttttaaaagagcaaaatacatctaagaagcaggctactaaaaacacacaaaccaaacagctggagcaaatctgtttaaggcagatgtcacaatctgttcttcctgggtccctcggccctaggcacagtgctcagcagagtcggacttcagtcttacataagtttctctaaaataatgcttgccttgcctcttatttgaacttcaaatattcctgcaaaagctaccactcctttgaaagcctcacatttgagaagggttttgcagttttaacacagcatttcgcctttgacacacttcacatcatggggcaggcaggtcagtgtcatcatcccatttcactaaggtgccataaagaagggagctgctggctcagggtccagaggatcagaccaccaaagatttctcctctttcccacaggactctctcctctaagactcttcctggctctgcagggggatgctggactgggttggtacagagcagggaggtggcctgttgcagtggcctgtggcagatggggcacaagactggaggggagggagctggtacgactggcaaagcagc

SEQ ID NO: 6035 - DNA, 7146 bp, Homo sapiens
gcgccgcgggctctaaaagctcgactgtcggccgggcgctgtggcgcacgcctgtaatcccagcactttgggagggcaaggcattcccagggcagtcagccctgatgcccaggggctaggcttgcaagaccgcgcattaggttcgcagagctagagtgcaaggccagacctggtaccaacagcatctccgccttcgtcctcatctggttcccgcctcaaacctgtacctgtgcggaggagcctggaagacggagtttcgcttttgttgcccaggctggagtgcaatggcgcgttctcagctcactgcaacctccgcctccctggctgaagcaattctcctgcctcagcctcccgagtagctgggactacaggcatgcgccactacgcccggctaattttgtatttttagtggagacgggatttctccatgttggccaggctggtctcgaactcccgacctcaggtgatctgcccacctcagcctcccaaagttctgtgattacaggcgtgagccactgcgcctagccggttctaacttttaacatgtaaaaggagagttgaactctgataaatatatattaaaggccaacaaggagcccagcattaaatattggggatacaggtgagcaaaacggacagccctgatccccagaacatatggtgtggagtaggaggcagatagtcaacagtcacgtggacgtaattacacgtgtacttttttttttctttttttttctttttttcagacagtctagctctgtcgccaggctggagtgcagtggcgcgatctcggcccactgcaacctctgcctcttgggtttaagcgattctcctgcctcagcctcccaagtagctgggactacaggcatgcgccgtcacgccccgctaatttttgtatttagtagagatggggtttcaccatgttggccagcctggtctggaactcctgacctcaagtgacctgcccaccttggcctcccaaagtggtctcactgttgcccagactggagtgcagtagcatggtcatagcaagtgcaaaggtctggagcatgaaacacacacatttcttgaattggacattataaacagtctcaaaagcatacaagtcagaggtgtggaagcttcagcaagttaaattgagaaggccttggagaattctttgaaagcccataagtatttgagcaatcctataaacatatgtgaagacctctgaccctgttttctgatggaaatgtccagattattgatctgaccagaacagtccaggttccatgatgcatgcagtggtgtctgtgatctgactgagagacatctggctctatttcagaagaactaaaactatagttccagctacttcagaggctaaggtgggaagatggcttgaatccaggaggtcgaggctgcagtgagctgtgatctcaccactgcactgatctcaccactgcactccagcctgggcaacaaagcaaaaccctgtctcaaaaaataaagtaaaatgaaagaattcaaaataattatgcagcaaaatgtttactgtatttctataaattcaaataaaacatgccaaatcctttgtccctcccataatttcaatgagtatgtacagaaaattcttagggaacaatgtgagccaggtaattgttgatctggttgagtagcactttagagataacttttatgtgttctcccattcaggacttcaccatgtcagaagaactcaattagccctcttaatataaagaaactggccgggcatggtggctcacgttggcccaacaaaacctttgggaggctgaaacaggcaaataacttgagcccaggagttcaagatcggcctgggcaacctggcgaaacctcgtctctacaaaaaatacaaaaaaattagccgggcatggtggcatgcacctgtaatctaaactacttgggaggctgagatgggaggattgcttgagcctgggagatggaggttgcagtgagccgaaattgtgccactgcactccagcctgggtgacagagcaagactctgtctcaaaacaattttaaacaaaacaacgaacttgctcagagaggttgagtaccttcgtaagttcatacagctatggcagggtaaaagttaggcctggcacttcagttgtctcaacccagcatttcttctaccgtgtcacggagtcctctccacacacgtacttttgtaagatacagtgaccagcacttaatgtttttctctgtcattttacaggccacttttctctcatctttgtaagcaagcctggataattcaacttgagataaacatgggctgctttaaagctttacagcacttgcatttttagttcttctgaaacagagccagatgtctctcaaagtcagatcacagacaccactgcatgcatcatggaacctggactgttctggtcagatcaataatctggacattataattttttcattttttttgtagagacgggggtctcactttgttgaccaggctggtctggaactcctgggctcaagtgatcagcctgcctgggcctcccaaagtgctgggattacaggcttcagccactgcacctaattctttcattttaattagagtgtttatctcttccaaaaggtggttttaaaatttcacatgtggttctctccttattttcagttgagaagaagcaaaaaaaaaaaaaaattagaaagtaaaacgattggcaggagctttggatatttttacttatcccattgtgcaacacattcagtgacaatacaggcttatgaagttgttcagatggtttgtctatgagcatgtctgttcctacagttctccagaacatgagagcccttcatgcctaatcttggcttcctgctgatagacttttaaaggggtgtgagttggccagccatggacctgggtacgcttccagtggccacagatgtgaacacaatgctgagagcaatggaaatgtaagcaaagtaacatgtatgcttggtgaacaatcagaagtatgaaatacgagaaaccaaacctgcctgattgataagaatggggggccgggtgcagcggctcacgcttgtaatcccagcactttgggaggctgaggcaggcggatcatgaggtcaggagttcaagaccagcctgaccaatatggtgaaaccctgtctctactgaaaataaaaaattagccaggtgtggtggcgcacacctgtaatcccagctacttaggaggctgaggcaggaaaattgcttggaggcggaggctgcagtgagccgagatcgcgccactgcactcaggcctgggagacagagtgagactctgtctcaaaaaaacaaaacaaaaaacaaacagaaaaaatggggggtagggggtttgaggagcacaaggcttggacctactagacctggagatttggggaacgagggatgccagccatgttccttgtactgtatgcaaaagggaagtaacaagtattgaatgttcacttacctctttcattccccaatatgaaatagatattcccatttgcaaaaaaaaaaaaacaaaaaacaaaaaacaaaaaaaaagaaggctcaggagaactagaaagcagatgaaacaaagaggacttcattcagtaccagatgaatttagtatttctatgtatgtatgtgggtctcctaatttgattttcaaattgttctttagaaagatttttagctatattaagatttcttaaaaagctgggccatgccaggcagggtggctcatgcctacagtcccagccactcaggaggctgaggcgggaggatcacttagcccaagaaaggctgcagtgagctatgaccatgccactgcactccagcctgggcaacagtgagaccctgtctcaaataaattgaaaaaaaaaaaatgctggaccaagagtataatttcaggcatcaattctgtagttccttactagagaagtttctcttaacatgtacaacactggaaaccatgaggaggtggcagcacagcattctctgctgagcgtgaggttggctcttggtgttgctttgctgcaactgtcatttgccattgatgatggttcttctcttcctccgagggagagaatgcagtctgagtgggggaaaaagcctgggccatggacttatagactgttaacattggagtcttgctagtgaacattttagctatgattggattgtttggatagctgagtttgatatttacaatatccctagcttaccacttaatgtctgctcttctagatgctgtccttttcccgtatcttgttagtattctctttaacccatttttcagctaagtgaagtgttagtattccctcctctgacacttgttcactcagcacaaagaattcctactgttacctctccagaaccctacggtcattatagttgaggaagctgatgcaggtgggagaaaggaccagacgcatggaccatgctgttaagggaacagggacagagtgggttttaatctggttcacccatccacttactagtttgtaacctgagagcttccacttccccatccccaacatggggacatactgtcatgggactgttgtgaagaatgacatgccacacagatgagcagtcctagctaatgttagctgttaatgggtgaaggaaaagcaggcacttaacatgtggatataggctatcccttatctttgtcttgtgacaccatcctcactagttcacaattgccctttcgtacaggctaagcatcccttatccgaaatgcttggaaccatttgtgtttcagatttctacttttttccagacttcggaatatttgtatatacttaaggtttttatgtatactttatgatcttagataattttagacagggtcctgctctgtcacccagtcttgagtgtaatgatacaaacacggctcactgaagccacaggtacatgccaccacactgcactaatttaaaacaaaatttcttgtagaggctgggataggtttaagcaatcctcctgcctcagcctcccaaagtgcaggaatcgcaggcatgaaccaccatgcctggcctatggttttaatatacaggttgggcattccttacctgaaaatccaaaacgttccaatgagcatttcctttgcgtgtcacgtttacgttttgggttttgggtaagggatgctcaagccatgtattaaaaacacaaaactagccaggcatggtggctcatacttgcaatctcccagcacttcgggaggtcaaggcgtgcagatcacttaacaccaggagattgaggttttcctacaaaaaattagccaggcatggtggcatgcctgtagtcccagctacttgagggtggctgaggtgggatgaccgatttgagcctgggagtttgaagctgcagtaagccatggctgcaccactgcactccagcctgggccacagcaaaagaacccctctcaaaaaacttaaaacataaaactctaatactgacacctacatactcctacccattgtcaactccaccttgctcaaggtcctaaattgttcactatcccgtctttggtatttattactcttagcagatgcatatatttaatgtcttttttgagcttatgagaagccccaagtgttgctttgaacattcccaggcatgtatcctatgtccacatgtagtttctcttgagtaatgcctcaaagtagaactgccattttccccaagtagttgtagtaacttacacaaatggtctttttcacattgacacgaggagtcccggctagaagtcacgcttttcatcactgaatgtcttcatctactaaatgctaatggaggtaaggataagactcattcatgtgcctggcatgtcattagctgctctgaacacacaatacccacggtttattatataaatccaagcctgaaaagttgaaaattccattcatggtattattaattggcaaacaaaaaaagctcttagtttttggaacacaggtttgaatctttttttttttccactttgtgtaactggagaccttaataaactattaagtaaactttctgcactccttcagtgttaccataaaactcccaaacatttggtgagacattacatagctaagtcttgtttttttacaaccttgggatgtagcagtcaacattcagcatacgtcaaagttcgttcttaggcagggttgtatagggtaaatacccaggaggctttctaaagctggtctgtattaccctccacccccagtgtaggggacacaccttataatcatcaagtttacacaggtaacctggacaaagcatctgctctgatccttcctcctgccaccccagtgcagttttcaacactgtaccatgaggtgccttcttgttagcatcaggattgtctaaatctcacatccggcaatggtggcagggaaaatccagcctgtgtcatggcagaataggctgaaagccaacattacaaaacagaccatttttgcagagcacattccaaaactatggacaagaccaacagcagtaaagttcagctttttattgaacatgttataaaagaggtttagtcaaaaagaccaaagcccatgtcatcatcagactcctcggagaggccatggcgcgggcgagtgtagggctggcgctgccggacgcggtgctagtcgccggatgaagtgagggcctcaccccaacgcagccttagcttcctcggaaggaccgagcaccttggcggcagctgaggaaaggggctctcgcgcctatacgcagcctcttatgtgtccacgcggaccaatcggcgcccgcaccgggcggaagaggcggacccaggacccactgaaggcgcctgcgcactgcgcctgattggttcttactgttgagaaagtttctcagcgcctgcaaatacggtcccactttatttgggtaaattataggacctgagaacgttaaaaacacttttaggttagggttgcctaggtattcggacttcgcctccgttggttccatgagttgcttgacttggcaggagctccgctgtggccctggtgacattgttcgtaatctcctggttaggtcgcggccttcccagccggcgctgaccctgagagtaagggctgcgtcccagcttggaggcccctgcttagcgcaggaccttggttgagataggtagatgtaggaggatg

SEQ ID NO: 6036 - DNA, 284 bp, Homo sapiens
atggccgaagaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgattcgacgggcaaccaatgaaacagacacacctgcacagttggaaatggaggatgaagatacaattgatgtgttccaacagcagacgggaggtgtctactga

SEQ ID NO: 6037 - DNA, 280 bp, Homo sapiens
cctgggcgctgtggtgcgtgcctgtagtcccagctactcaggaggctgaggctggaggatcgcttgagtccaggagttctgggctgtagtgcgctatagcgatcgggtgtccgcattaagttcggcatcaatatggtgacctcccgggagcgggggaccaccaggttgcctaaggaggggtgaactggcccaggtcggagagtgcctatgattgagatcatccagggacagtgtgatgtgcaactgataaaagggctgaagttaaagcctcactaacatt

SEQ ID NO: 6038 - DNA, 5354 bp, Homo sapiens
aagagacagcgccgccggccgtggggagcggacgcagtgatttgctccccctcgtgcagcaacccccacacccagcaccaggtgggtgtgagctggcgacccggtcacgcagcggggagccgcggtaacgggatggagggtgaaagtggggtccgggcggccacacccagcccttccgggaggagaaggggcggcgggggcaggggcgcctcggggagaggggcctggactggccgggttagtgtgtcaggagctacgaggaaagagtctgggacgggagtcgtggcggaagggctggcggagtggcggggggcggggggagagccgaggggccggagggccgggggcggctcacccggcggcccccggtctgaggatacaggggccggccatctagcctggggagggtctggaccccccgagcgggcggcgaggaggtgctttgcctctgccggcgttcactgggtcagggccagttcagcgccctggcagggaaggggtcgctgggcgggccggcccctcctctcgttctctccaggggatgttatgtaaggggggaggggagaggagtagggggcggcggtgccggggccttatgcaacccaaaggttagggtttcaccgtggttgggcggggggaagagggcaagaggagggcctggaaactctaacccccgctccccagactaactggccgtcttgggccgagagaaggtcacctctgcacctccccccagcctgtccgattgtgaggcccctagcccaggcctggccctgactgcctgggaagccggctggctgggtggggcgcctgggttagtcatcactgggctgcctctctccccacctctcggccaactcttggcccctccccatggcctccggcgaggctgtcacccccacctccctccggccctggttccagcctccaactcctttggcctgtcatcctggctgtcagattgggctaggagctgtcagagtgccagagggttgatggagcagctggtcagagggtcagtgccctgggcccaccccgccctgcagccaagggcacctgcttggcacagactctcagcagctgctgagtcctctgggttgaacagagctatctcagacagaggaaggtcggacggagttggactggtcacccaggggaaggaagatacacaaagttcatgcctcccaagagggtttcggaatttgaaccgcaccccgtatcccccaatctttcttaccctctgagtatagaaattccaaggcaagaccgccttggcccctcagcctggcgtgggccatgcccttggactgagtgtcagcacggacccgccctccccagctcacatcccccgagcctgccacgcccccagccccctccctgggccatgctgcagggcccggcttttcctgctgattcatgcgttggaactgtgggggcggggcttggaacttggaacaaagttcagacatggaggggccggcagacagcctggaattcataccagatgtacccggaatgcgcaagcggaatgcctggcatctgagagtcctggggaagctgcccagccaccctgcccatacctccctcccctccagcctgtggtcccctgcccgcccctcacagccccggccaccctgccgatacctccctcctctccagcctgtggtcccctgtccgcccctcacagccccgggggcctctgctgaccttctttcaaacgctaggcctcctcccttcctcactcttccccaatccaggcccccagaactctccttccagctgaactccctgggaacaagtcagttgggctgatcactgaactcacatttctggacctgaggtaccacacttctagtacctgcgtgctggtggggtgtgtccagggtcccgggccccaccctgtctgaatgctgaggaggctgggcccccaggggccgctagggcaggggagggtgagagcaggactgggtttctctagactccagttctggaaagaagagcaagggaagtctgtttacagccacctcttgctgctcagcgaggttaacagcttccgcgggcccagatcagagctgcagccctgcattagaatctcagaggtctactggggcaggaccctgatggccagcgagtgggtcagcgttgcagcaacatgccctgctcagatctttcccattttccctccctttcccttaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataatttaagagatcagtgttattatttaaacctttggagaggtgggggtagaagaatgaagggaagacctcagctttttggtgagaaggtttggttggggcacctcttggtttatgaacttaattctttgaagtagctggaatcctccctctcagcctgcaggaaacagctctgacttgctgactgtctgccagctgaagaggtggagtggagtaaggtggaaggaaagcagtgcaacctggggctcttcaggtggtgaggggctgggggaggctcttcctcttaaggctggagggttctggaatcctaaccgccctgctactaagagcaggacaggtctgtttttctcttctgactctgtcccagccttgaagggaccctgtgttacctttccttgccctcggattgaagatattctacccacccaacgggtaccaagcccttggggaaggaagtgcttttcaagactgggggccagcgattcccttttgcgtcctcttcctaatgaggctcctccgtagggccgaaaacaatgctgggggtcggggcggggcccagtgggtcgcttctccaacatggggtctcctgggggttgtgggggagggggagcagaactgctggaattacaggtttgccgggatatggtaaaggcgtggaaacct

SEQ ID NO: 6039 - DNA, 5428 bp, Homo sapiens
tttttaaagttcacaaaccccttgaactttatccatgagattttctgatgacccaatgacttaatcctgctactgacttaatcaaaacccagtccctacagaagagacctgctcccccgtcacagcgccccccccggccccccatgccgcttattttaaaagcgcagctcccacaggctgcctttccttcagtttctgtccatgcccccagccccaggctgccctctcttggcggcaccgtcccaccccgcctgctgcactgagcccgctgggcctgggggactcttgctcagtagaacccgaggccagcaaaagctcttagcccaggatggctgcagcagcgacagtcctgaaggctacagagacacctggaaagggaacaaggagagcacgacagtccctgtgctgaggatccagggtggtggcggcaggggttagtgtacagtctcgagaaaacagggcggcggcagggggctgcactgacctctatacaccgagagggtttttaaagttgaatgacaagggcacagctacaggaacgaccccaggaagaagtcccgtgacggctggagtcagaagcccctgaaacaagcacctccccagtgaggccccaccgtgtacccagggtgctcatgaccacccccaggctctgcagcctggccagagaccaccgaggccccaggaggggcttcagagatggagatgaagctgcatctccgagccatgaggcccagtggggcccggacagagggagcctggtgttcacacaccacatctgttttccaacaaagtcaaaacacggtgggtcctttcagaagatccccagcacccgacacttcaactcagactccaggcgtcgggcgaggccagacccaggagatcacagcctgtagcggggacagaaaggtgtgcactcctggaagcgtccagcaacttctctcttgttcaagtggcaccccaggtccagagcggggcttgtggggagaggagcacgggggcttcgtcctcggaggcgcggagctccaagcaagggctgagcagcagctgggagtctcccggaggccagaacattactggccccgtgtgcacatgcgccttcttggagtcccaaaaggcagataccacgtatcccaccaaatatctacttacagattgggaaattgaggcaaaaagctcaggtaattcccacaaggccacagagctggtaagcggtggggttgagattcagtggcaatgggccgaggtctcctgggtgtggtgtggaccctgatggtgagcagggtggggacctcctcgagcccccatggaatcaggctgcttaccatcaccttctccgtggcaccggcccctaccaccctgctgaagaccctcctgggcctctcctcacgtctccttttcctgcccctctctcaggagagctttccaagctgatggcctgactgtgccaccccaacctggcatttgaaggccttcaggagtgaggccatgtccataacccgcgtctccactgaaccctacgccagcccctacacgagccccaagcctggctgctgctttacgacacacctccatacagcccctgcccttcacccctgcccagggaaatttactgggcacagcgccttgcccgctgccccacagcaaagaatgctgtcctgccagacactacagacagcagtggacacgcattcttccagaaccagcccagatcctgcctctagggtgagttgcctgatgggtcttgactccgatctcctaccccgtgcaacacggggagggtgctggccctgcctgccctggctcctcaagagcaggctggggttgcctttcccgaggggtccccactacaccagccccagtgtcggaggggttgggggtcagcgcagagggtggcacgtaccaaagccaatgaggcccagcgtctccccacggatgcgggccgctcccgaggccacctcgcggatctgctccacgctctgaacccgcgtgccttcccgcagtgcctggtacagccacgtgttcctccggtacaggttgaggatgtggcagatggtagagtccgctgtctcttccacggctgcagacgggatgttgcacacggcaattcctgaaagggatgaggccaaggccggagatgagaaaacctcaagatcagtggggaagccccagggctcccagcccgccctcctgagactcggttgttggcaccgggggaggcccaccttatcgtctagcagacgcggggctgggcacgtgggcggtaggccctctggctctgatgcatgggaagctctagccccaacatctacccctccctcccaaggaggacttttgctccaggacgtggctcatgaccaacccaactcctatggctgattttgggcctgactggcttcctcctgggcttgcactgagtcccaagaaaggacccggagtggcaggaagccagtgggcctcagaccagactcctccaagtggaccccactcagcctcaaacccctcagggtctccctcatggagctggcagggtgacaaagaatggcttttggttttaagctatgctaacagtttgatgcaaaaaacatacgttttaaacatactggttttaaaaaaacacctccacccccacacggatgcaagggctggccccgggaacggaaccgatggccgaagcgtgtgcacaatcgccctgtggtcatgtgctcagcaccctgctctgctgggaagaactcagagcagacaggatgccctccctgccccgtggagcagccttcaggtcagggccgagggtggcttggggtgagccctctggccccacacgagctgcagagaccagggtcaagtatctcccagcacaaagcagctgtggcatggagagttaacccaagtcataggcagaaagggccctgccatttaccctcctcagccagagggtgtctggggaagaatgaatgactgccagatacaacaggggtgcaagtaggcagagggccaggctgggaacggcccctccctacacccgacaggtggagatccagaggcctgcttgcagcagagaccagaggggccgagccaggggcggggccccagagggtgggctcagcagccagcctgtggctcccagttgagctctctgaggaggggtgtggctatctgggcatcacgtcagcccaagtgaaatggttccctcctaatcccagctttgggacccttaggagagtgtctctcccagcaaggggtgcccaaggcactgggacagggccacctttaaggcagcccaggattcctctatcttaagtcctgaagattggggtggggacagattggggtggggacggcaatcaccaaggcagcttcttcggctctactggacaggaaacaagaccagtgggtgccacaaacccactttctagatggctgcgtggctgtctccccacaagggccacccctaggtctagggccttgagagtgacccgcttagcaagacacacagctcagagaaggtgaagccactgtgagcaggtcacccacccacccaacgtggccactgagggctcctctgggccaccgacccctgccaagggaccagtgtggttgacggtgactgaggccgaccaactttcccacgagctggatgccaggaatcttgcaggaaactggcctcattcatttgaaatagctcagcagagaagctggggcttgatcacatgccatgttattattaagtcagacagactgaggctgatgccagaggttcaagaaaatctttggcggctgggacaattttcattcctcgggcaggctaaagcccagcagggaggccccgcagcagaatcaccctcaaggacgctggctccgtgctgctgccggggctggctcggcagtgctgcctggcgtcaacagcagcacctcctcctaggagatgagctgatgctggctgggagaccccacaaggccacgtgtgtaaaggcacccgggtgggtgggtggcacaaaaaggcaggttgaggcaggacatctggtcagtcttctcaccgaacttggacattcagctccgtggttccactgctcaccggagtgcagagtcccaggacggggagatggtgcaggaggaagagctgcagccactgcctgggatggcagaaccttcccacccagaccgcggcggcgccactgccaggaacctccataaccctcaccgctctctcggagggagcatcttcttagctgtcctctatcgctctgtggatgcagcctcccttctggatgagtcaagctgatccttcaagtgccacacgatgggtggctctgatactcgcaggctgggcctcccagcatccacggagcctggaaaacggccccaaagaggcaagctgcttttctctcacggtcagtgccatcgtgctttaatcccttcatgactgccgctggcaaggaaaccacataaaccagcttgctagaggcggcgggggtggggaggggtgtagggccctctcgaggtcttcccggctcgtggggagaagtgcaggtgagcagcttcctcaagccttgccctgctcttgccgtgaagcgctgactctcgcctgtcattccagggctgacagctcagagccttgcgatcccagaaggtgtcaccagaggcctagtgtgctgcctcgtgcaacatggagggccttgttttctgggcctgcgagggaccctctttcatcaggagagggcctgcctgcagccacctgccgctcccagccctcagcacaaaaggcccgttgaccgcatgatgtggggaatatgcattcggagacaaaggacgtctggacagaggctcattttccgcctccagagtctacattcgaaaagtgccctttaaaagggccccgcagatgtcttccaagcgcccttatcagatgggaccaggatcaatgaaaatccaccactcacagcccttctacattttccaaaaccgcagtccctggtcctggtcgtcttctgtgggtctcagaactcagggaacacaacctcccatctcggccctcccaggccccctgtcattgaggccttggtgcctttctggccccactgcctgtgcggggcacttctagaaatggagaaataggaagttccacaggcaaggacctcccctctctccctggaaagcagcgtctggtccagccgaggaagggcagggtcagcacccgtatgggcctgggagctgtgtggtgaggggccgacgtgctggagaagcaagaggtgcgggggacaaggatttgagagcccctggcacatgaagctgtattctcctctgctgttgaaacttgggatttcagctctacccagagcacaaaggacatttgttttcaaacaaaaatatccttgtttgtgccagggaaagatggaaaattttagtttatattaaacacgcctttgaagac

SEQ ID NO: 6040 - DNA, 1516 bp, Homo sapiens
agtgctggcgagaggcagagaagctggatcctcatgcatcactgagggtgagagacggcgcaaccactctggagactgtttggaagttcctgtaaaaactaaacatgtaactgttctgtgacccggcagttgctctcctgggcatttatcccagtggattgaagacgctgttcacagacaaacctgaacttgaatgttcgggatcgccagcacaggacctgactactgttacatgcagtgactggaagcctgtcctgggagccgaggagcagtgcgaaagccgggcacagaaggccgcctcctgcacgttcccggatcatgctctggagagcacagccacggcgtcgggatagcacagccacggcgtcgggatagcacagcggctgccgttgaggggctgccagtggctgtaaggggcgcctcgggtgctcgtgccctgggacatctggatctggactccatcatgtccctctcctggtgcggcgttgaccttgggtcctcgtgatgttaccaccagaggaagtggtgaagggcacagagggtctctctacagttgtttcttacagctgcaatgtgaattcacaattttctcaaagtaagtttaattaaaaaacaacaacaacaacaaatgcaaacagaagcctcccccaagcacgtcattaactgcattggtagaaaagaatcactcactacgcgtaaacgctacacaagttggagacagatccaggggcctcagatgcctcggtgtgacttcatcgcttcagagttaggagactggctcactgataccactctttggaccacagttacattttcactattgtctccttgttggtcttgggtgagacggaatcagctgcgtccgctgggacttgtgacctggggcctgtgctgtgagaacgtctactcgggaggctctgctggccctgggccctcacttggggtgggtgctgtttcctacggacgcgcccaggtgccctctctccagccagctcctcccactgcaagtgaaggcagaggcgtccaccccaagtcaccagagcgcaggtgcagagaggaaaagctgtcagctagtgccagcctccaagggccagcgctacccttcaacagctggaggcaccactgtgcgaggctttccacaccggcctccctcaggaacaagacatcctcaccaggcaggggtgaggtatgggctccaggactggcttcagcaggcaccaggctgaagaagagacaagacaagctcaggctggtcagctccaacacacaccattcccagccaggggaccctcacccctctgggccctgtgtggggactgacacggttcctgcaggaaaccatttgtgccgtttcccacacacccggcagcctgagctatgtggctgacaggtgctcatgactaacgtgtcctcggaagggcaccccatctggggagcgggaagggaggttcactgcactgctcttaacctgcattcacacgtttgaaatttttcctaataaaaatgtaaaaagcac

SEQ ID NO: 6041 - DNA, 7740 bp, Homo sapiens
cttctgcgagggcgcgaggactccaggagccgtcctggttcgagcatttctgaagaaactgagttcccggcgttcgcagcctgggagtcacaggcgcccacccaccggttgcagttacaacacaagttgaagtcacagccttgccggaactcttatgtaaagtttagggcattggatctggaaggagtgggaccctgagaatcgtaaagggatatttgggtggacttgagcaaatccaagaaccctgaactgaggaagagcagtgtgagtacatggtcaggggctccatgaatattcctgcctgcaaccccagcttcacaggcaattcagccttctccacactggcccggcactggctagctgctcaccttatggctcgaggcaggacccccccgcagccttgcagctgagtgggaagttgctggaagttgtatctgtttattgcttttaaggctgtcatgagcagacataagacctcatatcacacaagcttgatgccaccaagaggacgggagctgggctgggtcctgagcccttctagcggtgtggctttggcttgtgacccccgactcagcctcagtatcatctatcaaataggcctaataatgggcatgtcccgggactgctgtgaaaacgaagtggagtaagattgcaacggggcctggtgaggtggctcacgcctgtaatcccaacactttgggaggccgaggtgggcggatcatttgaggtcaggtgttcaagaccagcctggccaacatggtgaaaccccgtctctactaaaaatacaaaaattagccaggcatggtggtgggcacctgtaattccagctactcgggaagctgaggcaggagaattgcttgacccgggaggtggaggttgcagtgagctgagatcgcacctctgcactccagcctgggcgacagagcaagactcccatctcaaaaaaaagattgcaacaggcctggcaatttatctttcattctgagtagccatgtaacccctagtggtaactaggagaaattgtcctccagcagtctgtcccctccctcagtagctggggcggaatgagatatggccctgggcctggtgcaagattttcacttgttttggaagcattagccacagcttttccttgatgggcatgtgttatcatgaggctgggcctcacctccctgcattggaccagaaattctaaaggaagcaacttcttatggcacagcggatctcatgcatggcatcactgccccttccctaggagaccgcacaaagccactcagcttcatagctgggctgtggcctcagaggcttttgtgcctggaggtggcagggaactgtggtgtgggggctgggccagccgggaaggtagagccgcccagactggggtctgggttcctgaagtcactgttatcctgcagggagacctcagccaagccccagtgacacgcagggtctcgctctccacgctgaaggctgtgctgagggctgagcaaaaagaggccagacaccagggagggaagcccgcctccccctccccacctcgacctccacaccagttaaggctgaccggcaggttgctgtgggggaagcgacagcgtgcagacagcactgcatgccaggccacaccttttatggaaatgttcctctgagacctgttgatgagcttggagaatgaggaaggggacggtccagcggccagctgggtccacaccctgccgccggccctgaggagggaaggcacgagtcactgcctattttgacccggcaagaaatacaaacccacagggtgaggcgggcagaaaagcagctctgtgggagacctgcaggcccctgagcatcccctgccccagtcaggttctcgcccaggtgcataaaccggccccatgtggcggcatccttaccaaggacccccaggtgaccggacaggaggggtgaggctaggctgccaggcagacagggtagcaccagatgggatgggctgggggctccagggcacggtgtctgtggcaacccaacctgggaagatgttattgctctgctggagaccttgggccaggccccgcgaagccctgcctagccccttggcgtgggttagcggtgctttaaggcagcccgaggcgaggaggccaggtcatacctgcgggagcttgatgaggcctcatgagaaagccctagtctcagttcctgggcccggggcctctgcaggcctccaccaccccatgctgcctagttcaagtatttgttgtgggctggccagatcaagagtcacctgctagaacacaggggtaggaatcttaggtgggagtgggaacagagtggcaccaggcccattccctcctggctctcaaggtccatgctggccctcaggggcttcctgtgggggactctttgtgctgtcactgcaagggaccctcctgcggatgggctggaggccacagggacatggccccagctcactgagctcctgagtggtcatgattgactatgtgcttgaacttggggagggacgtgtagatgggaagggggtgaccttagggagggtaaaagaggaccctagctctgctgccctgggacagtaaggggaaggcccaggcctggctgcccatcctctgtgcctacaacctgctctttccttaaattctgccagcaatgggccacccctagccccggagcagctcagcccacctcctgccagctgcatctccctggaggcccagggctttctccgacctctcacacaagccctttgcaaaagagctgacttcctggaggccagggcaggagcatctgccacaggtcaaggggcagggatgtcgggggtactcaggatggtgacccctcctggtccatgctgtgacccacagcaggggtttcgaggagactccggggctcggggacccccatcggcaggctgccaggcctccctgcacatgcaggtctccgtggtcctgcgtccaggcaggaaggcccctgggctgctgttgctggagaaggaatgtggggggtctcggtgccaagactggggatagcaaggaggtgagtgggaaatgcaaccacaggccagccagcgcccgtgcatggagtcaaagggaggagtcagcatggtgaccactgcccctgcaccgggggaggaaggcatgggggtcctggtgaacctctccctgtactgcccagagcccagcctgactccccccgaagccgggtagggatgcatcactccgactaacaaatgtctcagccctaaagggcccctggctccaggtcaccctccagctctacagaagggcagggacgaatctgatccttgttagcactgacacaagagggcgggacctgagtcagccccaggggaagccagcatgccctggaaaggctggtcccaccaaagcatgctagtgtgtctcccaggctgcacccaggaaggctgggttggggaggagcccagggccagatgggcagcaaagtgtatccggctgtagccagccacaaaagaggacactgatgtctggcagcagcacagaaacccctgtggctgatgtttcttcctcttggatgctgagggtggtttttggagaatagtcagcttcactcccaccccagccccaaggcatctcctcggagaaggctcaggcaggtggccaaggccagcaaggggcgggcctgcagctgctcaggcccccttggatctcctcctggcagacaggggtataggggatagcagcccatggggatggggccttggtttcctgcagaacctacacgagaggccaaaaaaaagatgggggtaccaaggagaggaaaacacccccggcacccaccaccagcccgcctgtagactgcatcctgtgtgttcacatgtgtgaaccgcacgtacggttgagcctggccagtgctcagtccttcactctgctggtctctgtcagggagagctgaccctttccagggccctgcctgcactgggcatgggggtctgagaaaggggcagcaccgctggcaggtggggtctggcactgccaccctcagaagctggcacacgaggtttcttattgctcctcttggctctggagcacaccttcttaatttccagaaaggacacaggcccaggagaggtggcagcaggggtcccacactggccctcctgctgatctccaagtggagcccggtgggcaggatgcaggctggctctagcccctacgtgtgacccacaggcctcccacgaagccgctggtctctgcagagtgagaggtgccgggactacctggcctccttgccgcctcggttaccgggtcaccgcccatcattggtcagctgcctccagggatctggacgtggggcacagatgagtgtccttacaaaaataactctgagtctgttcccagtgggaccaggttcctgagagcacgtggggccaggcaaaggccacgtggaagagtccggcagggagcgctcccgcctgcaggccagggttacggctgcaggcgctccaggtactgcggcagggggttctccttgacgtacttctggatgtaccagcaggtgagatgggccttcaggtcctcctccaccacgaagtccagggcggcctgggagccgggcagagaggagagtggtcagggcctgcagccggcaccagaaggtagcattgtctgctgcctccccaggcccggctccctggccacccttccactttgcccaggtcagtaactcccttgagtttcagtgtcacctgggatgatccccacagactggtccggtacacaaggaaaaaacacatcacctctcccctacaagcccccttgccccaggcagcatggaggacaaaggttgccctgcaattctcctggcggggtgggggtggaggaggggaagccggcagacggcccagctaagtcccagcagcagccctcaggggagtgacggtcattctttgctctggctgtaactcccttcattaagcccaaacctgctctccaggcagcctggggtttgggatgccctgaggatgaaggggttgggggcaggaatggggctcctgtgaagcacctgccacacaggaggtgtgtgaggatcttggaggctcagccacgccagggtcttgcagaacaggagcctgggcccagaaaggcggccactggcccagagaggacccagggccaagaagcaggctgaagtggccaccagggccaccgtctcctcggagcgaaggtggcagcccccatgtccccgtccccgcttggccctgccacctgcctgccctaccttggcaaggtgcttggcgatgccacgcccacggtaggcatctgggacctcggtgtgctgcaggtccacgatccgcttgcccacgtactcatagagcaggacggcccggtcatgacatcctgggggttgtggagacaggtaagcctatgctgactcccatcccagcggactcaggcaccaagacgggtggagggacaggcatttggagtcattcagctgctacagctgaatcctgaataacctctcagtgcctcagtctcctcatccataaagtggaggtacaataaaatgtccttcatagggtggtttggaggattaaatgaggtaacctctgtgacgtgcttacagccatgcctagaacacttgagccccacatgaacctttgctactgcgtcagtcctagcatcccagggccctgccacccctttctgtagccctgctccctgcatccccaccccaccacatccctggatctgggagtcccagaacccagcactggacacagaacagggctcagcaaatctgcaactaaggcagagcatgaagagattagagaggcagcgctgcgccacgcatcaggaccacctgctggaccctgagagagacgcagcaggaaagatcagaggcctgtggtagagttcatgagaaactgacgctgggcacaggaggcaggaacaaacgggttttcacactccaccaggcctgccaagcctggagctcaccagtccaccccaaactgctgctgggcaaacaattaactgaactttttcctaatcacagtttttagtgtctcatctatttgtctctccacctacccatccatcaacccacccatccacttatccatccaccaaatgtttcctgagccccaggtactgtttcagatgctgggagtatagcaacaaacaagctagacatggagtcctacccccatgaaaccggaaggggagaaagagaataaacatgaaaagcaagtgatgtgtaggatgccagggaatgggggcaggtgaagacaggaaggagagggcaccagccattctgagggaacagtgttctgggcagagggaacagccagtgcaaaggctctgaggcaggagtaggcctgaatgaggggccgctggagtggggtgggtgaggggaagggcagagatgggggcagggaggtgatagggcaggtcctgcagagcctcctaagccttctgagctgggcgccactagaaggccctcagcaaagggacagatgtgattcactctttaaaatcatgctgtgtttcatgagttttaacttcaaagccccagaaaatctgcccttaaagcctgtgctgggcaacacgaggggaaggctgacaggccaagaggtccaaccactagtccagggccaccggaactggggccaacggcagcaaggaggccttctggctcttggtatctcctttgattctccccaaagcctcaggagagtggctacaattcatctccccatttccagatgaggaactactgagatgcagggatccaagtcacacagcaggccaagatgacgctggagcccaggcctgcaggtcctgagccacagccattctttctgctccaccgacacacctgctacttcctgcacccgccatcgcctaggcacttccctctgcctgatgccctttctccgttcctgccaggcccagctgagggttccccagccccactcccctcatgcctgcagccccgcccccacaccagccctgctgcctcctccttgtgggcctgactgtccttctgtggactatgcctgccaccctggccaaggcccagctgtggccactgccgcctgtcctggctgcacagcaagggatgtggttcttggctccccacctgctggggttaattcaactcacccaggacaggagagcagagatcggaggctattctgggactgactccgtcaccaagggagctgcctacctagcctggccatttaattaccccaggctcattgagggcctactgtgtcccagtagggtttgggctgcagggcaggcagcagcgaacaaaactgatgaaactcttcctcatggagatcttacgtactgatgaagacacacaataagtaatatcattataaataatacaggggccaggcacggtgacccactcctataatcccagcactttgggaggccgaggtgggtggatcacctgagttcaggagttcgagaccagcctggccaacatggtgaaaccccatctctactaaagatacaaaaattagccagaaatggtagcgggtgcttgtaatcccagctacttgggaggctgaggcaggagaatcacttgaacccgggaggcagaggttgcagtgagctgagaccgcatcattgcactccaggctgggcaacaagggcaaaactccatctcaaaaaaaaaagaaaaaaaaaaaaaaagctgagcatggtggtacacacctatggtcccggctatttgggaggctga

SEQ ID NO: 6042 - DNA, 638 bp, Homo sapiens
acacgccccagccggcgaccggttccatctggctcgggccactctgacacctttagtttcggcaagggatattggggtggcgaaggggaggcgggggcccgaaggcttcggaaaacgatgggggagggggcagaggatacccgtcgaagcccccccctcccccaacatttcgatattggaatcactttccttcttcctcgggccagcctttgctctgtcccctcaggtcaactcaaggtagacagtgtggcgactggagaggtcggggaacaagctttgtttcagctaaggggaaaacaagcgttcacaggagtcccctgacacctcccactcggaagatagctaacgggggtcctgccaacccttcccatccaacttccatctgaaaaggattttctgctaaagttgggtccatggccatccagcacctgtaaggccggcaggagcgtctgccctctactcagttaaagcctgaagtcgtttcctttcgatggcccttaggaggcccaaaagaggggcgacagaacatgatgttgacacgggctgggcgcccccagaagcccgggaacaaacgtttctactttccaggtccactggtgtttggtgtacccatgtgactaatttgtccaaagagaggt

SEQ ID NO: 6043 - DNA, 529 bp, Homo sapiens
cctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcgtctccttgagcctccagaggactcacaacactccggggcatgttgctctttcaaataccaggaatggactctggggaatggggcacccttgaagtctgattatttcttccctgtagagccccaggggctaattaaactcgtgtttatgg

SEQ ID NO: 6044 - DNA, 787 bp, Homo sapiens
gctgcaggaaccagactgggggcgagctgagcacctgtagtcaatcacacgcaggaaaaaccagctctcacacctgctcctctgtaaagcgtcttccccaagcccacacgtaattttgttgctgtccttgaaagtatttcccaagatctccaaaccgctttaaacttccaaggtctgagcctgacctggcctcgctaacaaagggttccactgatgccgactctaagaagaaagttttcaaggttcttcgtatttgaactttctatggctaggcttatgtttaaaataaccacactgatttaaacatggtcttatagtcttcagtggctcccaggtcttgcctctcgggttttttttcctctttcctttgaatgtgccttaaccttcgtcttgcttttatttacctctgagtctggtttagagccacctggaaattgaatggaatctttagtctattagtctaatctagagtccttaccttctggcctttgctcattgcagagcccccacattattagtcagttgtaccacagatactgtgttacataaggtgaggagagggaggtggtgttatcagttccactttttccaggctagagtgcagtggcccgatctcggtgcactgcaacctctgcttcccgggttcaagcgattttcctgcctcagcctctcattttatcttggataaaagagaagctttgaaagattgcctccctatgtgtacagtcactgtaggcatgtatttgtgtactgtttacttagtcatgtcaatgagggcaataaaaaa

SEQ ID NO: 6045 - DNA, 472 bp, Homo sapiens
gcaaagtcccttcgatccgcagctgagccccagccaggtctgcggggagcaagaactggggtctctgggggctgcccctgctgctgagactgcgagggacaaattgggggtaccttgcagtggagaagtcctggcttctagcttccccacccccgcccatgtccttctatgcgttatattaagcacagcggctctcagggtcccagcactcactttttgcccctttccttcccccgtgcctcagtttcccctcttagggagcagatgccagactggctccagtagaaagcttgaggatccctccaggcagggtagcaggctccaagagcaccctggagttcctgccggggtgtgggggtgcccaagcaccaccagcccctctcgccgtgtgcccgtgagtgcctgcttgaccatgtggcttcctctatcgcaggccccacagacaccagcggcgcctcccgtttctcagacg

SEQ ID NO: 6046 - DNA, 6532 bp, Homo sapiens
agagactaacgccaatgatggagatctggctggtgaggaatcatttgttttggagtcggagccaagactgaattcccggggatttctggcgcgatcgcgtccaagtgtctggtgtgtaaggctcttcagtctgccctgaagctcagagggcttcgacagtacagatgctagaggcctctgcgagcaaaggcggcgctggcccaggggttcaggttcctgcgagcgttggcccatggcgcttccggatgcgctgtccggatccccgccggacacttctgcccccgcggccctctagttggttcaccagtttgcgtttgattcctgcgcatttcttatgtgttaggcataataataaagggtggggcaagcctccccaactgagagagatctctttgccggagaacctggggcctcaaccagctcatgggactgttaccttcagcccgttgctatccctagcttctgtaaaactgctggcttgtactaagaccttttcattcctggctacacatgaattcccagaggagagaatgggcgcggaggagctttagaaacacccgtgtctgataccttcgaagattctgatttaactgatctgtggtggggcctgggcaatggcacttgtataaattatgcaggtgaagcaggtttaagaaccactgcactcaatgatttggatgataggtactatttagcatctagaactgttagtctgatgtatgttttacacgctcgatcatcccctcaatagacccaggagctaagcgtcattatgccctttttacctcagaagtggcttgcccaaatttgcagtctgtaagtggtgttgcagaccagctgcagggccaagtgctttcctccatctttcccaagagaggaagacgctaatgcgctcagtaaaactaacacgctctgtaaggggtgaagctccacacaactcaggcttattctggtttctgtcagtagcgctcactttacccagcaaggaactgcttattttacacacttgaccctgaattccccttgccactcacacctgagtttgaactgcagctaagtagcccaggcagaggctgccctgtttccacagtcttggtgtggctttatttccttcttccatgcctttgcccaatgatctttgctatggccctgaaggcactgcctccctggcctatatggccctgtagctttgaaaagcctgaattcaggctggacatggtggctcacgcctgcaatcccagcactaaaggcaagagaattgcttgagcccaggagttcgagaccagcctcggcaacatagaccccgtcgaaagagggagggagagaagacacaggagagaccccgtcgaaaaaggaaggaagggagggagggagatgggaataccaaggagtgctttaaggtccccatctcttgctgtcacttcccccatctgcagtctgatgtaaagcttgaggtagatagaatgtggaaagagaaattgaggagtgggaagtgttcagaggggaaaccatttatctgaaggtgagagccttatgaaaaattttttgggccaggcgcggtggctcatgcctgcaattctagcacttcggaaggccgaggcaggtggatcacctgaggtgaagagttcaagaccagcttggccaacatggtgaaaccttgtctctactaaaaatacaaaaattagccaggtgtgatggtgggcacctgtaatcccagctacttgggaggctgaggcaggagaattgcttgaacccaggaggtggagtttgcagtgagctgagatagtgccattgcactccagcctgagcaacagagcaaaaactctgtctcaaaaaaaaaaaaaaaaaattggtgaagtgctttcttctttgtcatcgcatctacagtctcattggtcctctaagcatccccaagatgacagaaaaataatagatttcattctcagagaaacaggctcagatggggaggactggttcaagggtctgctttgggggccattgtgttcttgcatccacactccctgtctgtgtcgggctggatcaagtagggaagggagaggaaggagccatctcccaggggtggagtcctttgggtgatgggctttttaagcagccctaggggtagagacagatgggattaaccaacctggggaccttcacacacagataccagcttttaatcaaacagcagtttttactgagctccaggtggggctggcccagcatggccagtacagcaggctgccctcaagggccagtctgtggcatgacaggaaatgcaggggtgcacatgttggggctgccctttggcactcactggggtgggtcaagggagagcaaacaccaaggtcctctggagaccagaatcggccagtgcagccatttggcttctccttcaggaccagctgggtcagttcccaggccctgaggcaatgcctgcatcctgggtccgtggggcactactgctgtcactgctctgagggagaaagacgaccagcagcacaatcaggatgatgagcaggacaccaaccaccaccagccccacgcagatccggtaacggatgttctcccagcacttcttctgggccaggttctgtgtagtcttgttgaaggttgagctctgcggatacccccagacacaaagtgggagttagctggcaccctcttggcctgggagccagctcctcccaaccccatctcagtaaggcttagtctcctcctgcatcctccccatcttgtctactttctttcttttttttttttttttgagaaggagtctctccctgtcacccaggctggagtacagtggcacaatctcagctcactgcaacctctgcctcccgggttcaagcaattctcctgtctcagcctccctagtagctgggactacaggtgcacaccactgcgcccggctaatttttgtatttttagttgagatggggtttcaccatactggctaggatagtcttgaactcctgaccttgtgatctgcccacctcggcctcccaaagtgttgggattacaggcgtgagacaccgcgcccggccttgtctgctctctttctataccacctgccgtggaaccctcccagcctgactcatctcaaacaccggtgtggcccttgactttcagccctagtgtctcaccctcagttaacaatgccagtactcaggctggacacagtggctcatgcctgtaatcccagcacattggaaagccaaggtgggaggatctcttggatccaggagttcaagaccagcctgggcaacatggtgagacctcatctctacaaaaaatcaaaaattagacaggcatggtggtgcaggcttgtagtcctagctcttcaggaggctgaggcaggaggatcacttaagcctgggaggtagaggctgcagcaaatatgattgtgccactgtactagcctgggcgacagagtgagactctgtctcaaagtaaaaaagaaacaaaaaacgataccagttttctacctttaagaaggtccacagcttcaaaccaaggccttcttatcttgtggggtctatctgttgcatgtctaggctatgggtgcctgaggaaacccagaggccccacactggccctcaagaaggcctcaaccccaccaaggaactggagatcctgaatacagcccaagagagactttcccaatcctctcccctcccctccatgctcccccaggcctcacaccatatccaggagttggtctgaacgctgctgcagttcggccagcttcacaccacgctccaggaccttgccgaagttgttacgcataatttccgtcacctcgttcgcctgctgctggcaccgctccaactctattcctgcctggacaccaagcccgaggtcagggctgcatgaggcccccacctggccctcatctgcccctgagatctagaagcctccttctccccctgtaggtgggtacagcatgagagtaacagcatccttcgtgtaagggtatgatgtgtgcggagtgaaggtctggccttcggggtgagtgcggcacaccttaagtctcacaggctcctccccttgcacgtcaaggcagggcctaggacctaggtaagtcccggcttccagcacctcagcttcctctaagctgtcccaaggtgggatcttcccaggaccccaccctcccacaaagctgattcttttctcacctgctccagaatggcgtctacccaatcaatgcacagctgccctaaggtttcccactggcctaagaaggcagcaaagaatgggtaaccaagctacctggctggaacacacagggaggagacctaccctacaggctagaaaggtaattttgaagcagcacacatcatagtctctgcctaacccctctatccccaaactgagaagctcagatcttcctctttgggcctctgactggtcaggccagttctgcctcctggcctgatcctgctccctatatcactgctccaacttccctctccgtctgggaacctcagtggtaccggtttttggcctccagccttccactcagctggggtcctcactggggtccaacttacagagatgagactaactcttggatttcccagcctggggggcagctttgcctaacagaaaacaccagctcatttcagaggactgggaagggaggtcttggatccaagctggggaaggttgaaatgacaggggagagagaaagtctgggtcatgtgcaagaaaggcactgggctttgggtgcacgtaacagagagagacaccaggcaggaggccctggtataagccagaagcctaggagcagggacatttcagggagatgaataccagtggattagcaaaccacagaaactccttcctcttagcctacttccccacagcccatccctgttcccttcccctccttacaagaagggcaagcttcttttcctgccagcccacgtcacccattgtctacaacagacattttggcacttgactgaattccacttaaaaccagaaaacttaagtgttagaagagatctggtggtcacagagggctacctcccactcagccaagaatcctccttcaggatccttgcagctgcttggtatacagcctccaagaattcccactgtatgagtcctatctccccagctggaccacaaactcccagagggagggcagggagcagtgccctgcctttgtccaccaccatcccaccgggaggccagcacagtgctgaccattgcaagcaaggaatcagtgagtgggccaattacgatacagcctaaccaaaagcaattcttattctcaagagatgttctcccagcatgtttttctagccctgcatgagtttcgaggggcaggcatttgaaacccaaataggtcaatatttacccatgagctagaaaagcaacctgcttcaagagaggtcaggcaaaccactgtaggggaggctgcgctcacaggctggaggaagcagtaagcaggaaacacagaggaacaacgaagagagcagggaaactgcactctcaccttttcctgagtcaaccgtcatcactattattactactatagcattcaacaaggctccatcattcaatcctttgaacttccccacattcaaatactccaaggcaggctgggcgcagtggctcacacctgtaatcccagcactttgggagccccaggcaggcagatcacttgaggccaggagttcgagaccagcctggccaacatggtgaaaccctgtctctactaaaaatacaaaaattagccaggcatggtggtgcatgcctgtaatcccagctacttgggaggctgagatgggagaatcgcttgaacctgggtggcggaggttgcagtgagccgagatcacaccactgcactccagcctgggcaacagagcaagactccatctcagcaaacaaaacaaaacaaaaaacaaaattaaatagtccaaagcaaaaacttgagaatggataaatactcgaaaataagagtcactgctagagactgggaaaatgctggatattatctttttattttctattctaaatgctacagctgttgttaccttatttttcaacaaggggtgatatttgggtcacattctccaaagagctggctgtgcttccagctgtaatctggaccagtctcccccaatgcgaagccaggcctgcctggagccaagatggacccaggcctaaaagaacacattcgctccagggaacacagaggccttagactcaagtctcgggccctccttggcccccactcaaccagaggaaaaaggacactgactatatacacaggtctctgctggcactgtgagaaataaagctccagggaccctggaaggaggtaagcaagaggacaagggccatactgccttacgccacactgtcactcagcataatgtctgcagacagcagagatgtgataaacagttcctgaataaatggtgcctatatttttaaagatggggtcttgctatgttgcccaggatggtcttgaactcctgggctcaagcagtcctcccacctcagcttcccaaagtgc

SEQ ID NO: 6047 - DNA, 2664 bp, Homo sapiens
gtagaatccagccagtcagagagcaaatccttggcttcttccagcaacacctgaagagaaagaaacaaaaatccagcagcgggccacacacttcacatgagaacatctcgtgcagctggtgtgagcccatcagtgccctgaattcaaaggtgctgaccttgacctgtgaagagccaccgtctcctagggagactgtgatgcttacacaactggctcggcagggacaaatacaagactctacaaatgggcaggtctcacatgaactcagaggagcaaagccaaggggactgtgggtgcagaggcaaaaagaggtgggagggccgaggtgggcctggtgagcatgtgcagcctacctgggccgtgcagggcagggttatgggcagaggctgggcaggagcacacagtgtgtcacctacagcacaaccccttggtgcattcaggaaaagattcatgacggacacagccagaggttaggagagataggcagggcactggtcccagaggtctcaaaagccccatctccctgacgccattgactgaagatgccatccccacttgacacaccatggaatgggagtaaaaaccaccaatcccagcaaaacatggcacctatgtgaaccaggtcctgaccacacacactctaggcatgagacacgccccaactgcactcatgtcagaaaagagaaatgtctaccctccgccatcttggagggacctagagtctcaatgcactgacgtggacccaggacagggcgtgacaccaagcagatggtctgtggcctactatgggaaggggaggcaaagaaccaaggctggagagaaaaagtgtaggaaaatggcctggcagacagcaaggacacagggtggacaaagccacaacacagacagagaaggggcacagggcccacgtgggccaggttcctgatgcaatccctgcctacagctcctgaatcaaacagatgtgttaaatgtattgcaggcctgcaagtggcaaggcacgtctgcaggaatgagcacaccctccccaccgcggcagggcatccagtgggcagacaagcaccaaaagcagggtgtgcgctctggggagcaaaggctgccaagtctgctgcccgaaaagcaaacactgggcctgccccaagtacagggaaacgcgcatcctggccctcaggatcaccaaggtcacgacccagcaagaaccgacatcctaatcgaggtcaccaaacacccaagaacatgagcaactgtgaatgggagtcagcagaaacgacaaacagatggacgcttcagatggaggagttatcagatacataataaaatccagtaaatattacaggcttaaagacataaggacggactcccagatgacaggcaatagcaagcagggacaggccagcaaagcggcccagctggatctgaaaatagaagcaaacggaacctgcagagatgaaatctattaacaggcgaaacagtcttatccatcctactgagtgactgtttcacttcctgtctgaaggagaatttgtgaacaggaagacagaactgaagaagtcatccaaaatgaaacagagacaagaaggaaaattttatgaaagacaggttaggagacacggagaaggatgagatgaaatgatgagactcacatctaattggcaacccagaggagaggagagagggaatcgagtaaaggtgatacttgaagacacatctgagaatttctcaaaacccatgcaacaatccagccccgggaagcacacaaaatatccaataggataagtaaaaacaaatctcttacaatgtctttgtgaaatagcagaaaactgaaaagagagaatacttttataatgcgcctgatagaaaagacatatttaccaatcaaagaaaagtaatttgaagggcagccgatgttttcaacaacagccaacaatggaagccagaagacggcaaccaccttgaacaaacagggaaatatacacacttcaagatagacaaaagctgcttcccaccaatacttctaagataatgtttctaaaacttgcctgatgatagggctggaatactcaatgttgctggtcaagcatacagatcaacaatcaaaatgcataaatacaaaatgataagagacttctgctttccagtttcacataagtcaggagcttggaagttgccactctacctaacaacaggtctctgtagcagatctaagatctttgtggacctaagatcgctgctgtggatcccaatggctctgacttctgcgtgcaactgcagaagctgcagggacaccccgcggtggacctacctggcgtgccccatgtgagatgcgtcatagacggttggcccacagcaataccacgtcacctttttcccatcttgaggtatgaacacttcctttgttaggaatgaaggaatgacgatcacaagaaatgcaagaaacactgcacaggattaccaaaaacagcaacaaacatcacagtgtggtttgtgtttagtgtaaacaattcaacagagaccattttgttttactgtgaaaagtcacagtctcagtgggagcccagtgagatgtacggcacctcccaccaactgagccctgggtgggtggggcctcttcctccctggggttctactcatctatggagggaggcgataaagggaatcaatgatttt

SEQ ID NO: 6048 - DNA, 560 bp, Homo sapiens
aggggctacccaggcagagagctgagaacacaggggccatcagcctcgctatcacctccacccccaagtgcttggctccccaagggacagctctaaaatccccagaatctcaggctggtgggtccagctgagcatcctagttttcactttctcctcccaaaaaggaaagaaccttggtcactaaattctacgccttctggaaatcactctgctaatgacttcctgaatgatcgactgagaccaacagctggcccagccctgcatggaggagtaagaaaccctcatctgtcagagttaaggggcctgaatgggtacaggtcacattcttggagctcaaggtgacaggccagagcccaggtccccaggacagtgcagcaccttgtccaggcgggcctcccgtttctggctccgggctgagcttcctggagaagaggaaggtaagatacatggaagggatggaggtggtgtacaccatacctgcctggacctcactcatcacttggggagctggttaaacatgcaggtccccaggcctctgtcttggaggacctgaggttcag

SEQ ID NO: 6049 - DNA, 1788 bp, Homo sapiens
agaagtgaaacaagagatgaaggaatgttgcttgaaagaaggaactctcaaagttcctcagccctaatctaacacaaattgcacttagggttactggggggagggtgcggccgggagggttcaattgtccagcaagggcaacacgggttaagtgaaaggtagagacaggacctccactacaccccgggactctcacccccgagtagtagtggaagccctaccgcccactcccaccccctacaacagcagactgagaggccggcaagaggtccgagctgggaagtcctgcgcgccgcccccgtcactcagccggcggcgccatccgagcagagcagctgggggagaggagacgtcccctcgccccgactggtgacccgggcagggggcgccccctgccctgaagtccccgcgtctaagtccgccggccgctccgccagtcccggtgaaaagcagggaagttgtgtgtgctgggagggggggtccgtcggctctcccagggaagcctggcggggcccgggaactcagcggcttcacctcgaggggactcccgtctagagtctcgtggcgtccgaggcagagtacagcggctccccaagtccgcaggccgggggcgggatcagcgcggggctgggggtcaacgagcacttcctcctcccagccggggatccggggcttctccagggattctccgtggcgaggattccgggtgggggtggggatcccgcgcggttccgcccccgccaggccaggggcagctggcgactcgctcggtctctggtggtacgcgccacggcccccccaccccagctctgcgcgccccctcccctccgggcaccaccccctttccaccgccccgccccgtccaggcaccgcccctggcttaacccattcccggcgcgtccggctgcagcgggagaaacgcagggaaccgagagggagaggcggcatgtggacaggccgggcctcatttgcctaatgcaatgcggctgaactctcgctgaactcgcctggcggcgcctcacctccgagtgacccacccaccgctgcccgtgacatcacccgctcgccagcccgcccgcggggctcgcccgccagccccctgcccggccgaaccgggccacctcccccggagacgcggagagcggcggcaggaggcgtagggccgggtcgcgcggggccaagtgtttggcacccgggtgtgacattgtgcagctcggacgctgtgtcggaatgagacaccggcttgtgtcattgtctgtgacatcatgtgtgactccggccgccggaacccgacgcggcagcgcgggtgctgttggcacaaacacaggcagagggggccctcctccccacgctctgcgtgcttccggcgagcaaagccccgcccaaggtgtctcctagctggggaaccagtaccggcccctggtgcactgtccagctctggagagataaaaggaagagctggtgccttccagtggactacttcatcctagaagccctcgggatgcacgtttcactggaagaaaggcctagcttgggtaggtccctagaaagaggggatacccctggaggagggggtatcctattacccccactctctaaaaggaaggatggaaatgtacatgctacccaaggacattcttctagaagaagcctggctctttatatatgttgtcattttatcctcacagcaactccaagagatgttttacaaataaaacaggtctcagcaaggctatgtgggttgtccaagatcacattactaataataaagagtagagcaggtatttg

SEQ ID NO: 6050 - DNA, 2390 bp, Homo sapiens
acttttgaattctgttttatatcaagctataaaaacctggatcctgttcaacatacatacaaaagcagtactctaaaaaataattattattatattaacaatatcaaacacgctaactcctacacacgtacaaagaccttgggcatcctttataccggccacttcctggccacagctttgtaaggcagtacctgggaaaaggggacggacccaagagagccggccccaaatcctgactcagcactgcagaggcatcagccgggctgagtcatgcctgagtccgaagggccccctctcaggctgagaaggaactttcaggcccagggaggagcagagccttagggggagcacatgccgagcaggaaaacgagctcacattttcctggggtagagcgaggtgcccggcagggcaggggatgaacggagggtgcggtgggcagaataacggcctcccaaagatgtccacgtgacagtccccagagcctgtgactatgttaggttacacagccagtgggaactaaagttgcagatggaactaaggtggctaatcagctgacctgaaaatagaaagacgacctgggttctctgggtaggcgcaatgtgatcataagcgtccttaaaagcggtagagcaggccgggtacagtgactcatgcctataatcccagcactttaggaggctaaggctacaagatcccttgagcccaggagttccagacaagcctaggcaacagaatgagaccctgtatccacaaaaaatatgtagctgggcgtgggggattgtctcaggggactgagacaagaggatcacttgaaccaggaggtccaggctgcagtgagccttgatgccatgaccaggccactgcactccagcctgggcaacacagcaagaccctgtctcaaaaaaaaaaaaaaaaaagtggtggagggaggcaggagaggggaggcctcaatgaggtgacgggaaaaagattcaactacccacagctggctctgaagatggaggagcctgaagtcaagaattacggtcagcctctaaaaatgaaaaggccagaaatgaattctcccctagagcctccagaaggagtgcaggactgccgacacccagatttgagccccgggtcagccttctgacccgcagaactggaagacctcgttttgatccacgaagtttgtggaaacctgtcacggcaataggaaacaaatacagaggccaaagggtcaacagtgagaggtcaagcttgccctgcccctgcccagacctcagccagacttctgggtggcagggcccacggtggcacccccagggcctgtccctgccttggggaagggggagcctgagaggacccaggaggtcttgggcccttcggtagtagacaccaagccctcgggggaccaccctctagttgaggccttgggggatgaagagggagggctcagggccccattgcagggccagcctgtaggggccgtggggccacctggatgtgacgtctaatgctggcggtgctcacagctcgccacaggaccctaaaagcccctgccagacgagagctcatcttttccttctttctcttccagttctgtcttccattccaccattgctgaatcccgctcacggcggccctgggctgcagagggcagatgggtgaggctcggcccctgtctccagagagctgaagagggccctcggccccacccacgaggaggacagtcatgaggccgactgtggaggggctctggacagaggtgtccggggatccctgagcctggctgcactctccctcctggttctttccttgcgtgcacacgatcagctatcgtttacaaagagtccttggtgttgcctggttggctgcccaggatgggagctcctgcccccatcggacatgtaaacaaaccaaggtctgtccagttccagctgacagggcctgcacctccgccagggctaggcagaagtagcatcagagcacaggagacccgggaggaaccgagaaccagcgctgctcttaacagctcccagcggggtgtgcccaaggcttgctgggcactcacaggcaggtcaggccacaggaaaagctaaccaacctttataagggaaaataggggccgggagggctcctgcgcccccatgctgacgtccaagatgctccggatgcgcttgacctcactgttggataggttccccttgatggccaggatagcgctcaggtggcctttgctggcaaagagagcatcctgtcagcccagcctgtcacccacacccctactcaccagctccctgcactcccggccagtgccacagggcccgacagccaacgcccggcccacgagggggctgcacttcactctccctcacccatgccctccacctgatggtcccaagagcag

SEQ ID NO: 6051 - DNA, 1064 bp, Homo sapiens
tggatgaactctgctttcctgctcacagacggcagggtcctgttgagccccaggatcctgtctaggtggaaggcaaacacctcactcatgtccaagggctgcttgagaagcccacaggggctagggccacagcggagcacagcgccaggtgcgcccccctccagcaccagcaaacgggctccgctcctagaggacacaggccggagccctgccactgcgctgtccgccaagagtcgcattcttcggatgtcatctttgctcagccaggagggggcgctctcgctgtagatcctaatgttgctctccctggagctgggctgcaggaagtctgggcccccggctcgcactcccggaccccgcaccaacctccagggtcgctctccaatcttaaccaggtttgctccctgagcgtacccaggtgctacagcatcagcttcccttgccgcttcctgcggctgaagggatggtccgaccaaagcctcctgccctggggcagccgatgccactgcatgctttttcctgcgcttgggcttcacggtgccacggatattggccggcttgctgcgcttggagcgtagggtaatgtacaccacattgggctgcagagtggacccattgccctgggactctggaggggccagggtaccatccaggggtatctcagggaaggatggctcggcggtgtcgcggctgcgatgtggccccttctcagccgcctgtccatgctggagagaggccctccccacctggctcaccaggaagcccaagtagatggcacacgcagtgcccagcagaaggtttctccgggtccttggacgccggctgctccagagcttacgcacccgcgggacgcacagggagcagatgaaccagtttatgagctgccccggcttgtctggacaggtcatttctctgccgcatccacatgttgaacggagtttaaagtctgcagttggctcctgctaatgtgatgcatggtttcctgacttcagctgccgcgtccgcttcgggaggaaatgaccagtgctttggttaagaatgcacattatactgcagttctttgg

SEQ ID NO: 6052 - DNA, 753 bp, Homo sapiens
aaaatcggcgagctccgccgagcgggcggggcaaggccgaggtggcagctcctgagagaccccaaggaagaggggagcatcgagggctactctggaaattgcaaaaatccgaaactgcaattcgaacaggaggtggatttttttttttttttaagtcgagacttgggacgccaagcacaaaagccagggacagcccgggaaggagggaccaggtgtcctggggcggccgccgggcaggtctggaggtccccgagtctccttcccacccctctggctgcagcggccgcggactgactggagggagagtctcccgccccggcgcagcgcccgcccgggtaccgtccccaccgcgcctgggcagcccgtctcgggaaatggtggaggccgcgggaccttctcggccacctcctccagcagctcgatgctctggttaccagattcgcgtttactttggaaaaatctaagatcgccacatccgaggatacatgtcttaaggaggcgatgagcttcccgtgatttttttttgtaagagattctttgggtagctttctttaaaagccagcgcctcgtagtatgcccaggcgccccagtttggggaagtcggggtgaagccccctggaacaccctcacactggcaaagaagctgcctcggctatctgcgggctccgctgcgttctccttacttttctccccctcttaaatggagttaaaatggctgaattccggcttttaattaaaaacagcctataatcg

SEQ ID NO: 6053 - DNA, 618 bp, Homo sapiens
atagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacggtgggtggtgtgcgtatgttttgctgaggcctggtcatcacgctgtggctccaaggctgggaccagccacagaccgagaagccggtcaggtgccagccagagattcagggctccctccctctgaacatcctgtctttagcccatccttggcatcccagctcatgtcatcccagccacctgcagcagtgccctagggccccatccctctgcggatcatgctcttgggccacctcctccaagaagccttccctgacctccctcctccca

SEQ ID NO: 6054 - DNA, 1284 bp, Homo sapiens
gtaaaaacagctttttttattttttattttttattttttttgagacggagtctcacactgtcacctgggctggagtgcagtggtgcgatcttggctcactgcagcctccacctcctgggttcaagcaattctcctgcctcagcctcccaagcagctgggattacaggcgctcccccaccacgcccagctaatttttgttgtatttttaggacagacggcgtttcactgttggccagactggtctcaaactcctgacctcgtgatccgcccgcctcggcctcccagagtgctgggattataggtgtgagccaccgaacctggcccaaaacagcatttttggaagctacattctgtgagatgttcacctgtttgccacctcttctcgtgaaaaccatagtgagtgccagtgtgaaaggaagattgcagcgtatatgtcaagtagaaacatgtttgaattttccatttgtctgtggggaagaaggtaataacagtaataacagactgaaggaccaaaggaaaatagggaagacgttgattatggacttggatcagattctagctacatgatttgaaaatgacactgcctctcctattttgccacaagcctgtcatttggagaactggcagatcatttatgttcagatttaattttctgttttagaatcccatggagtacatgtgaacataggaaaatcacactcagcagccaagctatccttttgcgataatgaaatcactttaaaacctataacttgatcttaggttggcaaatcttaaacttaacgatccttgaaatttcctgcctgctgtgactgtgatgcagttggattcaactggtttacactgctcttgggtcggcaagaccaaaaaaggttggactgcactgtagcatgcttatgggttgaggcagtggcagaggcagaggacttggccgtcagccagccagcacaggcgtaagaaaatagcatgagaagtttcacgagcctgaaaccattgagacagtgattacaacctccatattaatcagatgagggtttgtaggtgacatagcattttacccaagtaattctgaacagactgtggcttatgataatacattttaactagcaagtgtgtggactataaaacaaatatctagagttatatatggatgtactatcatttggtgataaaagcatagaaaaagcataagttggagtatactgggtttttttgttgttgttaaattcttttccatcagaagtaagagctgttggcagcaactaataaaatgcaacctagtga

SEQ ID NO: 6055 - DNA, 5608 bp, Homo sapiens
acactgcctgcgggaagcggctctgtcacatctacctcctgctgtgctcagagagagggaaaggtcaaagaacctgcccctgatgcccagccaaggcatctgacaccatgggtctcctccagatggccagagctggtctcccttccactccaagaaacggggaccatgcctgggcctgctccccttccttgggccatggcccccctgccacagaggcctggtggcccctgagctgctgctccgagtggaatgtcctggtctagaggcccttggctgctccagtgtcttaagacccatatgtgagtgctggctctgaccttgaacaagctcctccatcactccaggcctcgtttttcaggtgtatatgatgatagtatctatcataaatgatgacgtaaacagatgatagtatctatttaactcctagattgttatcaagtcaaggacaacaataggaaaacatgtcacctgtcaactcttacaaagggagggtaggacaggtggcccctgactagggggtgggggtgcagggggcacccgacccatctggccagccacagcctctgtaccctgctcccattttcaggcctcaatccccaagcactgttggccctggactgttttccccccttaattctgtttctcaatgcctgcttcttcccagtaagtgccacaccctgagggtgggtgggagagtgaggcagcagtgcccactttggctgggactgggcactgctgaggacagcatgggccacgtcttccccatctcaagactggctttttggctgggcatcgtggctcacgcctgtaatctcagcactttgggaggctgaggcacgtggatcacttgaagtcaggagttggagacatggtgaaactccgtctctactaaaaatacaaaaattagctgggcatggtggcaggtgcctgtaaccccagctacttgggaggctgaggcagaacaatcgcttgaacccgagaggcggaggttgcagtgagccgagctcatgccactgtgctccagcccgggtgacaagagcgaaaatccatgtcaaaaaaaaaagactgtatttttggctgggcattgtggctcatgcctataatctcagcactttgggaggctgaggtgggagaactgcttgagcccaggagtttgagaccagcctgggaaaaatagcaagaccttgtctttatggaaaaaaaaaaaaaacaaattagccaggcatggtggcacacacctgtagtcccagatacttaggaggccgaggtgggaggatcccttgagctcaggagtcggaggccgtggtgagctatcagttgcaccactgcactccagcctgggtggcagagcaagaccccaactcaaaaaaaaaaaaaaaaaaaaaaaggcggccttttcccagctgccagcaccctggctagttagggtttccctgaatccgcaactcctgtttgatggcgggtctcaaacgctgggaggcagcagagtcaccggtcagcggcaaggcctggagtctccattcggaaccagcacccgggagcctctgccgcgggtggtcgcggggccgtacgcggaggcgatggctctggtgctttgagccgttcctcagcagcacggcacaccccctcctgcggagccgcaaagctcacgagtgtgcggaaagtgacccggaccctgcagctgcctctcggccggagctagggctatgggtgttgggtgtaacgggtcacagaaggaggagggggaaaaccagtgcctcgtctgccacagaccaaccttcctggcctggcttcctctacttcttgaaattgactttttgaacatacgaaacagttggaaacattcctcctgggcagcaaaagatttctcagacagcttgagtaaaagacgctgactcagcagcagggagatgagcctttcgagggccagggaccagctctctctgcacactttggggtttccgccactccagggctgaatgtttatcaggctgggtgtggaggtttacgcctgtaatcccagcactttgggaggccaagaggggaggatcccttgagcccaggagttcgacaccaacctgggcaacacagcaagaccctatctctgcaaagaatttaaaaattagctgggtgtggtggcgcgcacctggggagccctaagaggtcaaggctgcagcgttcacatcactgcactccagcctaagcaacgcagaaagagaccctgcctcaaaaaaacaagaaagaaagagacatgatagattagggttccccaaagtgtgttccacagatatttttttttcttttgagatggagtcgcactctgtcgcccaggctggagtgcagtggcgcaatctcggctcactgcaacctccacctcctgggttcaagcaattctctgcttcagccttccaagtagcagggattacaggggcccaccaccacgcctggctaattttttgtatttttagtagagatgggggtttcacaatcttggccaggctggtcttgaactcctgacctcatgatccacctgcctcagcctccaaaagggctaggattacaggcgtgagccaccgtgcctggcctagactaccattttcacagtagaactggctgttatctggttccctttgctatcttttccttttgataaagctggatttctcatcccctaaaaacctgataactgattcttcacaagtcctagggtatcttcaccttgataaaaacaaggaaaccatcggaaaaagtggcacaccagggaggctgccaataaaaaggatttggagtgtttgtcccgcctggggatgactaaggctgactcagctcaggccccggggaagtcctgactttctctgtagaatcaaaacctctaatcagctgaagacctgccctgtttggaaaagtggactgtgggttatcagctgtgtttgttggagctgacaagcctcaactgttcgcaagctccgaggaagtctctgccctgccctgtttctcggtgagggatgcagatcccagtgtgggccagttgccccagcgtctccagccccgtcctgacctcgatgcccagggtgtccacgcacccaccgtgccactttctgggaggactttgggcttgacctgctgtctttcagccatgctcaggtggagcgttctgttctgttttcatttacagacacacacggcaaccctccccctcaggcactggaaaacacacaccccacaccccacacccaggaggctattttggtccttccctccctcctggaccaggaaaccctgatggggacacgaagaaacagttggggctggcagtgatgcaatagctctgacgggcagacagctcctgggatgcggcctttccatggcccggctggcccggctcagcttaacacattctggccggtggccagtgggctgggctcaggccggggagtgacagcgaccgaggctgcccggggcacctacctgtcttctggtcgccgctgaccaggaacttgaggatgttgttcatagcccccatgtagaagatgagccgcagctgcgtgacgcacatggtgaccaggctgagcagcaggatggggctgaacacgctgtgcatgaaggagggggccactgcagggagagggtgcggggctcagggccggggcacactgtccccaccaccggggggacacgcagatccctccacgctggaggccaggagggggccctcgggacgggcctggtgagggtaacggggttggcgctgcggtggggtcacctcttgggtgaaatcaggcaaatccctttccctcccccaggccttcctgagcgcctctgcagaacagggcgggcggggccgcctccccttttggggtgaggtgggaatggggtgagccgatacccacagagcactccctgcccgtcgcccggctgcggtctcaggcgggtacctgcggcatccggctggcacttcacctccaggtcgacggtggacaggcacagcttgtggccctcctgcagcgccacctgctccttggcactcctcatggagctgcccacactcaggcgccggcccaccgtggtcacctgcttgtagaactgcttccctgtgatcttgtggtcaaagcccagccagctgaacttgatcttcaccctggggccccgggagagtgtctgtgggtgctgcccgggaccccggctggggggcgggggctgggggcaggcgggacgggggcacctctacttacgagtagtccatgtcctccggccccgggaagggctcaaggggccagttaaagaagcagttgaggaaaaccagcccggagcagccggcccagaccacgaggacgacgatgaaggagacaccagcatcatagatgagctgacaggcaccgcggggacggggtgggggggggagggggcagagttagcccggggaggccagagccgcagcaggcaggggcgtctggccacccctgctgtccctgtgctgagccgcgcaaagaggcacagccctgccagcctgggcgttggggcatcaggcacccgccttccagtcctcccaccgtgcctgccctgctggtcatctgggcctggcgtgtgattagccccccgactcggaggccttcctgaccgccccgccatgaccacggcacgtcttgcaggctcatagtgatcggcccagcagaggggacggtgctcctggtccgtcggcttgtctggtattagcggagctccctgaaggcgggaaccggccagccccgtccactgatgcttccccagtgcctctgagagctcacatggcagaggccaaagaaatgctcaaggaagccaggcatggtggctcacgcctgtaatcccagcactttgggaggccaaagtgggcggatcatgaggtcaggagttccaggccagcctgaccaacatggtgaaaccccatctctactaaaaatacaaaaattagccgggcatggtggcgggcacctgtaatcctagctccttgggaggctgaggcaggagaatcacttgaacctgggaggtggaggttgcagtgagccgagatcgtgctgctgcactccaacctgggcgacagagcaagaccctgttcccccccaaaaaaaggaggaggaagaactttcgggatgctccccagtccaggggcatgagaatctctgcaagtccataggatggctggccccagagtcccagctcccaccacttcaatgcccaggtggccagcccacaccgtgtccccctctcctcgccaacagcattcccacacacaccaccgaggaaaggggcttttacttagtgtgagggtcagaggtgggagaagcccctacggggccctggcagacccacagggtctggggaacttgggctgatggactgtgaggtgtttgcttcgtcctgaccctgtgtgacttccacaggctcaaaatcctgcctaggagggaaacagctgaaacacttggccaagagcagtgctttggctggcggggagtaacggtacaataacagcaggctgggggttggggagcaggggagcagcgggagaccaggatgacggaggagacgggggcaagactcacaactggaaacagactcacccaccgcccttccc

SEQ ID NO: 6056 - DNA, 1505 bp, Homo sapiens
gcctcagagaaccgtttcctgcccccaggcctggaggccccaaaggcgccagaggagctgggagcccctgtccctggagcggagccagcgcgggcgagggcatggagggggcgtcggcccaggacacgcgggcgaaggcagcttttgcagtgcagcgtggggcccgggggcccggcccgcgactcgactcatctcgattcgaccggcgggcggcggcgagaggaggccaaggcctgggctgcccggtctctgcgcgtcccgactccgccgcgcccgccagccccacctgctacttctttttggggaagaagctgaatctcttctccttgtctttcttgccgaggctggcgtcggggccggagagggaaggcaggggcaggctctgcgccttgacgcggatgctctgggactcgttgatggcggtgctcacgccctgcagccaggacagcatctcctcctgcggggcggagggtcacggtggagtctggaggcccacagccccccacctcccgggccaggcaacaatggtgggggctcttgggactgccccttctgagggggcctccagggcaagcggcctggggtcctccacctacccccttcttagccaggtctgggctaggctgcccgcgcttacctcatccttgccatggaagagccactcgctgccattactcagcctaggaggacaaagggtttcctgtcatggagacacctctggagggggcgctgggcagagggctggctctgatcccacaataccctgagccgaacatccagacccctctcaggcagcccagcactttctgagaggtcaaagtctggaccatcagcctctttgatttgaaaaacccctgaggagcagctcaggcctggcactggtcccctacagagggcctctgccctgccactaatgccaaatcaagccatcaacccgagctttcaaaggccaggaaggcctcacctcagcttaaagacgtgcttcttcttcttgtagttggcagcaatctcacagatggcatgtctcagggccaggggttcctccccatggtagggcatccccagggccaggttcttggcatccttgtagaaggttagctcactgttcctgagcacacagtacaggttgttccaggacctgcaaagatgcagacaggcaggtcacccacatcctgatatggtatctctagagtcaattcctatagcttcaccattaaaaaaaattacaccatgtttgttctgatacatagtaacatgttttattgttaaaaaatcatctgcatgtaatttcattacaaaaaattagctattattaacattttatgtattccttctagtcttcacattttcgcatttttttttttactagtcacagatagctaaaactgggttatggatatattcaattttatatcgtgtttctaagcataacactaaatcatgagtatttctccatatcctcaaatatttctttttttgccaggcaagatggctaacacttgtaa

SEQ ID NO: 6057 - DNA, 1945 bp, Homo sapiens
agcttaggcgagctggttgctgggagaaaaacagatgttaaatgaactgcctttgggtcgaatctcattgccccctgaatcgtggacgctccagttcagagcgaagtcccaagaaacgtgtggctgctgaagccaaggctggggccggagctggagctggagccggagccggagccggggtggtggctggggtgggcacggcagtggacggaagttcctcagaggccagcctgtcactgactgtgtcctggagggtaacagctgagaagaggcctgacacgttgaagttgatgtctggagacagaaggagcggagacggctctcagagaccgcgccaggctcctcactccactggccgggaccgtttccccttcccctgaacccatctggaccatgttcagcttccccactcccgtgtgagcctcaccaccaccccacaaagcaggcagaccatccccgttgtaaaaatgagaaactgaggctcagacttcctcctggacttatgttgtgatctggacagcctctaccaagcaaatgcaatcagcacgtgggaggaaatcttgccatctgtggccaggtggccacagcaagttgggtcccaggactatggcgatgttgctgggtgtcatcttgttcacctcctgctcctcggccagccgtgccaggaacttcatcagctcctcctcctcctccttcagcgtctccaccttgttggccatggtcgtatggctgtgactacccgggctgcctcctaggccttgactgctgcctgaattcttggttgcctgactgagcctggagatgatcccaagggtcatctcaaactcggccaggatgcgggccagctgattctggatggcacagctcatctccaaggccttcctgtggacacggcaccccatgggtccaggcgcccgctgccctcacctccactggaaacacttggtggggcctctcctccctcacttccggcccctcctagatatccttcatctctgctaagctgaacaccctcccaggcctggccaccctcactgacctgggaactgtccccagcctggtcattcttctgatgtggatgccctcaccacctggaccccctcccagctgagatcacgtcttggtatccccaggtgagggctgggccccgtctgtgctcaccccatgctggaatcagggtccagctccttgaagctctcagccatcgtggtggacagagccatgaggggaagcttcttctgcagggagggtggggccggcgatgagtgtccgtgcctccctccaccctgcctgagcaccaggccagccccttggggcaggggaggagggaacccaggagggccacagtcccagatgagagtggaaacaagatgacaaggcgtggtgggggtgacatttccctgagagcatggatggagcccctctccatctggcgtgccctttcctcttcccagaagccacttgactgggcaggaaggaatgaccaagtcctactgcagactgggaaactaagatgcagggagggcagggagcttgccccaggtcacacaggtggagggagaatgggagcgggagctctttcccctgtcccagggtatatatggctgacctagccaccgctgagttcaaacgctctatggctcccaatttccttgccttggccacactgaattgtcaactgattccaaaacatggccccacactcccaccccatctggagttacggggaatgcctgctctgggatcagagaccagggttcaaacctcagttctgccacttactagctatgtgaccttggacaagtgactttatctctgagcctccagttcctcatgtgtaaagcaatgcctgcccctagggttgtgccagtgttccatgagacagtgcactcatatgttagtaacaagctggcggttatcagccaataaacgctgcctcttgatt

SEQ ID NO: 6058 - DNA, 3751 bp, Homo sapiens
gcagatctgtgagtaaggagccagctgcaggcaagcagctcgagggcaggtgggcatgatgtctggctaccactcgcactggacgccacacacacagccagggtggcagaaggccccacctgccatgtgccagtgggacaccaccctcatggtctgcgtttccaggtttccaactaaggactgagcacactctcaacatggacctcctaactgctctcgaggatggacagctggcctcaagggaacactgcaaagtggctctaggaagaagccactgtccctccagaccataaaaatggctaccaagggcagagccagcagctttcgctgtaaagtttctcaagaaaatcacagatattcccctctgtgatgttcagctcagcctggaaaggaggacgctgaactaaacagaagagaaacagggaaataaacagcatggcaacctacatcaacagaaacttaattattcaccctggataactgagtgtgtgagtgtgactgcaaataacaatatagcaaagagaagtttgagatctttggctcagtcattctagaatcctgagtcacagcaaatgcacagcctccatgaggctgagccacacatgaaagctgcttccacccacagactggtagaggccactgacatgcttaacgatgatgatgatgataaaaatagctaccacgggctaccacgtgcacacacatgttaagcagttcaaacaggttattttgtttaattcataccacaaatctttgaggtaagtattcttgttcccgttttatagaggtagaaactgagagttgaagaggctgaataatttctcaagcacactcccaactcgaccacccacaagcaaaaaggcagagctgggattcaaacacaggtatgactgtgtgtggacatctcccctgtgctatgctccctgaaggaaaattctaagtggtgttgtttctgggagaaatctacctgtgtggtctttaaacctactctgacaggagcaagggccaccactctgtatctaagaccactgggaacagtcttcaggcaacaaggtgaccagggcagctgcagagggtatctatgcccctgccccctagcgcaaaagtctgtttctctttccaaatggcccgctgggagcaactatttagggagaccatacctcctcccacactcagttcccaggcctgagccacagagtcctgccacaggagggaggacctgcctgtcctgctccctccccactccaggttcctggaggcctctgtgatgattccccaggaaggactacaggatctggcaggcagcaggtggcggtgggaggaggagagtcctgggagcacagcactcctaaccccctctgcctctcacagaacaaagagggagtcatgccatgtcccctgctcccacaaatgccccacccagaggggctaatgcctaggattgagggtcttgtgtgctgaggaagtcctgtcccccaatcccctacaaaagccagaaccagctactaaggggttagacacagacagaactgtctatattaacatttcctcctaaaaaacaacaggaatcctggggaaagaccactggcctgggactccatgagccctggcttctatctctggctttatcaggtgaccataggcaagtcacctagcctccatggtctaggctctcctgcctgttgggtgggaatcattacatatcacaatcattacagctgaccttcagggaggctgtactctgggtcaggaattgtgttgggtgcattatcatatttattctcacagcaccctttgcagtagctactattttcatacccattctcagatgaggaaactgtggaacaggctggttaggggacatgcccaaagtgacaaacttagcaaaggtggacctggcactcagtaccacatctgtttttccatgctcttaaccactgtaacatacagagcccttttacagagatcaaggacagaggtaaaagtgttttgaaagcaaaaaaaaaaaagtggggaggatgcataaaataaacataaatcaccccctgccccgcccagacataattcagggaagagtcctaacccccaagaaccttctgtggaacttattcgcaacatcagagacctccaacatagaaatgaccctcaataagtcattcctctttcccttcaggcaggaataatataactaactgaattatacaggtgagaccacgaaggtcaagcaagggtgaccagcttaggcccctggctggcaggtaaggaggagactgaccccagcctcctggctcctaggggaggaaacagtgatgacaaaggcccctttgcatggccaaggtggagccctttctaccaaagtttaaacgttttagtataatatccaagtgcatcttttccaaccttaaaaacatatttaatttccttataaagctggttggcactctcctcctcctccaaagctctgtattaggcagggttcatagttgtagacaacagaatgaacagtggttagttcagccagaaaagggatgatataggaggatactgggttgatcaaaggctctctgggagggctgcagatttagagccagtcagccaggaacgatgcctgaaacataccttagagctggagaaagaacaaaaccctacctttcttcaatagctggcaaggtggcaaggtctggccccatgcagcctgggctcttcccactctcctctctccctaatgcgttgccctactcgctgcttcccaggcaatcccacctcaggtctatgaacttgccattccctctgcctgcaacctagacattcacattgctagctccctggctagctcaaatgccaggtttctgcacaaatgctcctccttagagaggccttcctggacctctaggtctctggccctagtactctatcccctctccctgctttcctcttctacttcactgctccttaacattgtgttatacattgtctgtctccccaactggaatgtaagtggcaccagggcagggacttgggttgttttgttccttgctgtaagcccagggcccagggccagacctggaacaattaggtgctaagttatttgctgaatattctatgaaggaatgacaaaggaatgcataaagaacttcaaagttcaactcctcgaacttcaaacttcaaatccccaactcctcctgcctatgctggacgattagggcagtaacaggagtcaacttgtgctgtgctgtcaccttgcctggatccgcatcagccctgcagctcccactttggaggagacttgcccagggacctacagctctgaagcttctctgacagcctctgcagctcttggaacttatctgggctgctgctgtgcagaccatggatgcatagctgagttcctgcccctgatttcctagagtctcagaaagacagggaagtgacttacccaaagtcccctttcaccctataaacagttcagcccagggagtgaggctgacacgcaaatgcagctatgtatagactcagagtcatccaaggtcagggctgggtggagccttggtcacatgcaggccaacctgtgtctggagataatgcaagccagtgcaggggttagcgtgtacatggactctggagtctggcagatctaagccccacccaccaacctgtgaccttggagaattatttgaaaagacattatttgaaaagcagatgtaaaatggaaataaaagttcctatttaaaacagtcagttgtcccccatt

SEQ ID NO: 6059 - DNA, 2781 bp, Homo sapiens
gaagccctccagttcctcctccagtctttacctctcatttcagcctcttaatccctattttcagaggcaatgtggtataaaggataaaggagtggatttagcttcagttggtacatgctgtacacatctgcacctagcctgagttttgccctctttaaagtttgtataatatcgcctttcattgcctcctgggttcaagcgattctcctgcctcagcctcccaagtagctggaattacaagtgcctgccactgtgcccggctaatttttgtatttttagtagagacagggttccaccatcttggtcaggatggtcttgaactcctgacctcgtgatccatctgcctcagcctcccaaattgctgggattacaggcgtgagccaccgtgcccggccgtatattgccttttcataggaacgttgacatagttaaaccctaccttatcgtatgatcatttcacccatgagctggtaccaccttttgccatgactctggggaaggcttgggctactctgtgctcgtagtttgtcccctggcccataccaaggtttcacccctccaccttcctcctttgagaccagtttggccaacatggtgaaaccccgtctctactaaaaataaaaaaaaattagccaggcatggtggtgggacgcctgtagtcctagctactcaggaggctgaggagagtctcttgaatctgggaagtggaggtggcagtgagccaagattgtgccactgcactccagcctgagtgacagagcgagactctgtctcaaaaaaaaaaaagcaaaacaaaaccctttagagacaaacaaaaacagaggtttctaccaacagactactccactaaagcaacttcttcttttttttttttttttctgacacagagtctcactctgtcccctaagctggagtgcagtggcacaatctcagctcactgcagcctccgtttcccaggtgcaagcgattctcctgcctcagcctcccaagtagttgaaattcaggcacgcgcctccatgcccggctaatttttttgtatgtttagtagagacggggtttcgccatgttggccaggctagtcttgaactcctgacctcaaatgatcctcccacctcggcctcccaaagtgctgggattacaggcgtgagccactatgcgaggcctactaaagcaacttctaaaagaaataattcaaaagaagaaaaattataagcataccttattttattgtacttcagacactgcctttttattttattattaaataaattgaaggtttgcggcaaccctgtgttgagcaagtctgttgacgccatttttctatcagcatgtgctcatttcatgtctctgtgtcacatcttggtaattctcatgatgtttcaaagtttttcattattattatatgtgttatgatgatttgtgatcagtgattttttggtgttactaatagaattgttttggggtgctacaaatggtgcccatataaggcagcaaacaatcaacaaatgtgtatgttctgactgcctcactgacgagctgttcttcatctctctctttctcctggggattccctattccctaagacacaacaatattgaaagtaggccagttaataaccctacaatggcctctaagtgttcatgtgaaagaaagagtcacaggtctctcactagaaatcaaaagctagaaatgattaggcctactgaggaagtcgtgttgaaagctgagataggcccaaagctaggcctcttgtaccagttagccaagctgtgaataaaggaaaatgttcttgaaggaaattaaaagtgctactccagttaacacacaaatgataaaaaagcaaaacagctttatttgctgacaggaaggaagttcaagtggtctgattagaagatcaaaccagccacaacattcccttaagttgaatcctaatccaaggcaagatcctaaatctcttcaatgttgtgaaggttgacagaggggaggaagctgcagaagaaaagttagaagctagcagagcttggttcttgaggtttaacgagagaagctgtctccacaacgtaaaggtgaagcagcaagtgctgacatagaaaccacagcaagttagtcggaagatctagctaagataattggtgacagtggctatgctaaacaacagattttaatgtaggcaaaacagtcttctcttggaaaaagatgccatctacgactttcatagctagaaaggagaagtcaatgcctggcttcaaagtttcaaagaacaggctgactttctcattaggggccagggcagctggtgacttcaagttaaagtcaatgtttaccattctgaaaatcctagggtctttatgaattttccacccctcaaggttcaagtgattcttctgccttagcctcctgagtagctgggattacaggcacccgccaccacgccctgctaacttttatatttttagtagagacggggtttcaccatattggccaggttggtctcaaactcctgacctcaagtgacccgccctccttggcctcacaaagtgttgggattacaggcgtgagccaccacgccaggcttctagggcctttaataattatgctaaatctattctgcctgtgatctatcaaagaaacaacaaagcttggatgacagctcatctatttacagcatggtttgccaaatatatatatatatatatatatatatttttttttttttttgagatggagtttcgctcttgttgcccaggctggagtgcaattgtgcgatctcagctcactgct

SEQ ID NO: 6060 - DNA, 547 bp, Homo sapiens
aggtattctagctgacgacactgaagcacagagaggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagcctagggatctgtgctcccaagagcctgttgacattgtaaacctgaatccaat

SEQ ID NO: 6061 - DNA, 444 bp, Homo sapiens
acgaggtcaggagttcgagaccagcctggccaacatggtgaaaccccgtctctactaaaaatacaaaaattagctgggcgtggtggcttgggcctgtagtcccagctactcaggaggcagaggttgcagtgagtcaagatcaagccactgcactccagcctgggcgacagagtgagactgtctcaaaaaaacaaacaaaaatacaaaagttaactgggtgtgatggcacgtgcctgtagtctcagctgctcaggagtctgaggcagaggttgtagtgagctgagactgcgcgccactgcactccagcctgggagacagtgagactcagtctcaaaaaaaaaaaattatatgaatgtaatgggttcatcattttaaaatgaagtatcttcaaaatttgtttcaagttctcatggaatcgatattgataaatatatcttggtattc

SEQ ID NO: 6062 - DNA, 348 bp, Homo sapiens
gagctggcgaaggtcggccgcgctccgatccccaagagctcccgcgggctgggcgcgggacgccgggctcggccttagcccccgggatttagagcatcctcgcgaccacccggaggcttctgggggccactctgcggatgaggaagctgacgcctgggtgcagaaccccggacccccggattcagagcccaggtccagccgcgcttccgcacaaacttgcgctcggagcaagtcccctccttcccagcactcatctgagaccagaggtgtccccaccgtccccgctagcagcgctggttatattgtgggccaacctttaaaaaaataaaaaggaactgttaaaccaca

SEQ ID NO: 6063 - DNA, 765 bp, Homo sapiens
gctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaactt

SEQ ID NO: 6064 - DNA, 737 bp, Homo sapiens
aggtggataattactgtaccttcctcatggaaaaagttttatttaaagtgttatttctcattgaatactatcaaaaaggaaaaaaaaatgacctaaacttttgagatagatttggctctagtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgggatgtggagacgctggtagcggggccaggaaggctccggacggagcaggttttctggaccacagacacactgccccggcgccctccgcaggccgctcctccccaggcccatgacagtgccccgctggtttctgccgcgctgccggactggagctcagacggccttcgccagcccccccaacccacgcagatccctgctgacctgggcaactccccaccctcgctgaaggttcgaggaccaccccgctttcccgagaggagccgggcggcgggtacttatctccgacctccggctagtgggaaaggccgcgcgaccgcccgtcctccaactacagggaccgcacggtacgcgccaagcacagccccaaaatggactcgcggctccggctagctccgcccccttccctctcccgctt

SEQ ID NO: 6065 - DNA, 2969 bp, Homo sapiens
accacacccagctaattttttgtattttttagtagagtcagggtttcactgtgttagccaggatggtctcaatctcctgacctcaagttatcctcctcctgcctcagcctcccaaagtgttggaattataggcctgagctaccacaccgaggccacaggaccactctgaagcttggtgtagcttccagtactccacctgccccatttctgggatgcattagctcttttgttgccaagactttgcttgcgctgtgccctccaccctttagacccttccccttgtcacctgctggacttctcaccgttcatgatccaccttggctgtcacccgtcttctgtgtaattccagacccctgtggtgccaggttcaagcctctgggcagggctctgtgttccccactgtgggggaagcagcaagggctataatcactggagaacccaggacccagcagaggacaggcacagggaggcgggagatggtgtgcccgcaggaagcccttccaccttcctaggcatgctgagtctccacggggttggaagacggatggagaaaggacaccccttaaccctgtcccagtcccccaggccttgatgaccctgacctcagtaaggtcagaaagcagaaggcagtgggatgagatgtcaaactctgatttttctcccagccaagatcaccagggactgtggggctgcatctctggcaaggggagaaaaggacccatggccttgacttctgctcctcttggatattagtgcccatcaccgtgtgactgagggctgagtggcttgcaggcatggacatatttgctgccacacagctgcatacataccccagctgactggaggccatccccctgggtgatgagaggtgctgccttccctctggtagtccatggtagagatgaggaccgctaggatcttttgtttttaagagacggggtcttgctatgttgcccaggctggtctcaaacttttggcctcaagtgatcctcctgccttggcctccaaaagtgctgggattaaggcatgagccactacatccagtcagggtctccttttatttatttttttgagatggagtctcgctcagccacctaggctagagtgcagtggcacaatcttggctcactgcaaccaccgtctcctgggttcaagtgattctcctgtttcagcctcctgagtagctgggattacaggcacccgtcatcatgcccagctaatttttgtattttagtagagacggggtttcaccatgttggccaggctggtcttgaactcctgatctcaagtgatccgcccaccttggcctcccaaagtgctaggattacaggcgtgagccaccacacccagccccagggtctctttttagggcagcagacacagagattggggtcagttttggggagtggggccagacccagaactcagccaaacaatactgtagtcttgtccttgcctcctccctgactccctgactcctagggttgctaggacttggctggctatgccactgaccaggcagctggagtcagggcttgtattctctactcaactggtttgccactcagtttgggtggggtggggtgaaatgattctggggaactgagaggactaagttttcctgacatcagaagccatggggctccctggaacatgggacttcttccaggccttggcagcccctgcagcctcggtgatccctgctgtaaccctggagagggccctttcccccttctgcacctggcatctaggtctgcacctacctgctgggacagggggtggtacagggggggtgtctaggcctggggaactaccgaggcagcctgcctggctcctcctcactgagtttccctctactctcctctctcaggcctctctgactctgaaagcttgcctctctcttcctagctgctcccccaccccccaaatgggttaaaaataccaaagttcccaccacatcagtagccggagcaattatttcaagtgggccaggccctctgggaggcagatcaacttcatggcagtctccacaggctggagacaactcaccccacgctgggagcatgagcctgggtccctgcccagctctgcatgtcctgctaagggtcctgggcctcacagctgcagttctccatgcgtggagacagaaagatggggcttcttaggctgggagggctctggggatgcagcgccagggagcattgaatttctggtgctcctcacccaactgctcctgagggttgatgaatggttgaggtccagcctgggacagctccaggcagcaggggatgcccaggaaccaacctcatggagtcccttcagttggggtgcaggacacctgggcagccccttcctgcctgcagccccccatggctgggaatttcccaaccaccaaacacaaggctgaattgacaggccgcctccaccagtgctgggacaatggagccttatgccctggaaatctgagcctgggtgggaggccggggcaggtggaggcctagctgtctgcactcagggaagccctgcccccaggatcccacccagacccactgccaagacggcaccagggcaatcctgtcaaggccccgcatggcccacccagggagggaggcactgggtgagttaggcagacaatgccaggccctcaatggtccctctgtgcagggttccccctcaggacagaaggaaggaaccatctcccgcccgcttcctgctgggcgggcatcggggctctggcgctcctgctcgcacatctgcggctcagcggggtccaggcctgggcctctgaaagaaggcggggacctgggttgggcgcaggatcctgttctccgtgtcgtcggccctcgcaggcaggggcagcaggaaaggcccgaggaactggggcggggaccgggcctggggggcgccgatgtccttccgaccgggcggcagcagcctttcatctcctgccagtgccggcggccgaagct

SEQ ID NO: 6066 - DNA, 633 bp, Homo sapiens
gagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctgtgcttcgtcaatggcttgttcatcatccagatgtggctactgacatatctacacttcgcaccggagtgtctggaattgtggctatcctgattataggattttaacttaactgaaatgcctgctttgaataaatgtgttgggttttt

SEQ ID NO: 6067 - DNA, 905 bp, Homo sapiens
gccgcggtacctgtgccctggcccggggccaaccggtggccgggcgcgcgcgcgggggggggtcaccgttggaccctcggaggacaatgggcgcccattgttacctccccagcgccaccccccagtaggcgacttctctcggagaagatgccgctttcgactccctaagcacaaagaaaggtcgccggacgctcggtttaaagagggacccggaggtgctgccgcccgggtgcacggggacaataggactccgcccgcaccccggactcccgcactaaaactcgtgcgcccacctctcccgatcccaacaggccgacctagctgtgcgagtggcgggcggtgacccgcagggaagcgaggccacctgagtgcgccgccccggccaggccgcagctccccaggtccctctcagcccgggctccggtgggcgcggagggggagggtcgcgttctgtcagtttctagctcgctcccctcagagctgcagccaaaacccggagagtggaataagcgccctgaagatgccggagctcccggctgagcaactggacacgcgacgaacagcagacgctacaggttctcctacccagagggaggcgtttcttctccctcagggtctttcaaaaggatttgcctaaagctggggcaagccggtggcggctgccccagacgcgcgacgaggcgcaagtggcgcagctgccggcccgagagagtaaaattcaggccgcggtggcacctgcgcccgccggtcacccggccaccgccagcgccgccgcccggcgcgcccctcccctccgccggggccggagcgtgaaccgggttaatgaatgctaattttcttaatcggcctccgtctcttcctcctccgcgagtcgtcggcctggggaaggagtaggcgacaggaaa

SEQ ID NO: 6068 - DNA, 1355 bp, Homo sapiens
cgggaagccagtgccagcgtcactcacaggagctcttctcagcataggtctttatccttaagtgaggctggtcctcctggctgcctgtgccaggcctgggcaaggaaatacactccacctcccttcccctgcttcaaacaatctggcaaaggggtacaggtcaccccagcttctcccctaaacaatctggggtagtgggaaagcagcagtcacagaaggttgtggtctagttctgggaagctctactctgagcctcgctggagttttcttatccatgaacctggcccagccccctcacctcggagcagaccccgctcctgcaggctttgtaagggcggtctcttcgcgatgagccgctttagtttgttgcgcacgcggttctgctcggtgccttcgggcccccgaactgcaggaggcaggtagagcggggcgtgagcgcccgggagcctcgctgcgctcccggactctccctccccagcccgcgcctcactggagctccggcggctgctgaggcgcagcagcggcttggacaccagctccgactcctcttcttcgtcctccccggcgctcagctccgcgggtccagagcccgacagacgcagctccagggggttctcccgatcctagacccggggcgggccgtgtcgaagtccgcagcgcgcggtgccaggctcgcagctctgtctcgtggtccgactgcagcaggaactcgtggccagggatcgtgcggatctgagggccaggcaaggaaacgctcgggtcaacgggaaggagtataataagcagggagacctagcgggaggcctgcgcgggagattgggggcgccctcgggtcgggtggggccttggggacgcgcgggagggcgctcacgtgcaggacgttgcggcggctggacaggtggcggccgtgcgccagggccgccccgcgcaggtccacgctactttcgggccggctacccgctggtccctgacaatgagggaggaaactgaggccacggtgttgtttccttcactgcttccctctccccggtgggctgtgaggaggtgggaggcttcctcacttctttactttcctctgcaccgccctccccgctgccgcccccacattggcgtgaggcggtaggcagcgcccgcacccatcctgcgcctctcgctcacactcacccagcctgaggagggcgctgtcggcggtggctctcggtagaacaccaggctgttacccgttaacaccacccaagacgggccccagttcttcctgcggggacagagaggggaggtagtggtagcgaacaggtcattctagaatgacacgaggagggtgctcttccaacaccctgctctaccctatggagttg

SEQ ID NO: 6069 - DNA, 659 bp, Homo sapiens
ttgactttgatatgtttatattatagatataatacataaaacatctagagtgagactctacgttctccccaaaagaagagaaccaagccgtccttccctgctcccagccccagtgatgcgttggcgggaggccacctcccttcccgaccaggagccagggcctctgggggacaagccttgtgggcagcccaggccggaggggctggggaaagctgagggcaaaggagaacccccctcacctcattggtcccccaggatcaaaagtaatcccaaaaccaaaaggaaagggagtctcagacccttcccccagctgccgacggagagtctcattttggcaagtatccgagcaaaaccaaaacaaaacaaaaaccaaataaaatggtggtttagcagagacgcgcacattcacattgcacaaggcactgctggggcacagaggccagatacaagtgttgatatcggctgataaagcaaaatatttggaaagcttgtcataactccggtccctctgggatggactgatcgtgcttcgtgttcctaggcacaaggttatcctaaatactagagttgccgggctcccagctcagccccaagaattctcccctcctcgcagggagaagccaccgcctggccccctcatcttagacgcaccaagtccg

SEQ ID NO: 6070 - DNA, 7571 bp, Homo sapiens
agtgtgagatgacgggaccagagcacgttcctggctgcagaggccacaagtcacgctgtctctgagagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagtgcaatgcctggcacacagtcggtgcttaataaatgtttcttaaaagaaccaataaatgaatagtgacctctccggggagaggagccctgagctcacctcctgcccccagcccagggctcttaggtgcttgttggtgtcaggcccaggcccccctctcatcaagcagccaataaaactgccctggttggcgttctcatttcacagatggagagactgagcccagagagggagagtcacctgtctgatgtcacacagaggtcaatttggaccttgccaaagcctcttccttctggtgaccttagctgagaggtctgccactagcaggtgcttcatgaacagttgctgaacaagtggtgtgcatcatgctcccgctgtgaacttcagcttgcttgaaggcggattcctccaggcctgcaggtacctggcttgagacgttgcctggccctcaaaacacccaggttccccccaagctcctccccagcctcctccctgctgaccttggggagctcccggtttgccctcagcccttttctggaggccccagaatcaccaagaggtaatcctgcctgctgcctggaggaggcgatgtgggagactcaggaacctggggtgtcccccagccagggggcgggcgttgtgatccggcgctgctgagcactgcagtgccttccctgatggccttgtgtgccgctccctgaccctcccgtagagcagccttcccatactgctgggtgacacttgcgtaaatcatttcacctcttggctctgtaaaacgggactggggtggtccctaccccttcagggtgtcgtgagaatgaaaggcatcaagtgggcaaagcgcttggcatggccctgaaccatggtgggcatttgtcacacacgctcatggacttattcctgggtccctaggataccctggagctcctccccaggttggacctgctgctagcatgagagggaagaagggggacacagacaccaaagacagttctcgtcctcatctaaatgctggcgacttccaagggcacctccccaaggcctcccctgagcctagactcaggggtctccacccacctgtctctgtccctgctgggatgaccaggagaagcctcaaacccaggttggccaggactccattcctgatctgccccccgaagccagtcctgcctctactgatggctcctgcatcctccaggtggtcccccaaacctgggagtctcccctgccttcttcttctcacttgctcccacatctgatcgctcatcacatcctgtcgactccaccttcaaggtagacccggagtctgccctcgtctccccacctccacggcccccgcttcggccacggccaccagcaccaccgcctggactggtgcagtcacttcctcctggcttccttttctccctcagcccctcacagtctgttctccacacacgaccagagggacctgtcagaagggacctataccttccagcacagaccctcccagggatcccagctctctgagtgaaagctccctgtggcccgtgaggccgggtgcgaccctggccccccagcaaaccctccacttgtctgatgacctcgctgcctctctccctcgcgtactcccttccagccctgatagcttcctgctgttcctcaagaagccctgggtctttccacctcaaggtctttgcaggtccctggagcccttgtccaccatggatgtccacggctccctcacctccttcaggtctgagctcggatgccactctcgacagccaccttctctgacccttcccctggcttaagtagcctctgcctgctcgacaatctctccctctacgcccctgaccatcccgtgttcttttttcatagggggaggggaaaggcactcccaggagagtggacagtgtgggccagggcctggacgtgtgggcagcaagagggtgggtgaggggagagtggtggagcctgggtggctgagcttcagggggaggcatcctccaggcaggagtgagcaggccagggtcaccctgactccgtcagccactggttgtgtgacttcagggagctctctctggacccaagaacctgcaactgctgttggagacccactaagtggacctgtcatctgacagagggggaaactgagtctccaaagctgctgctgtgacctgctgaaagggtcagcccagggatagggacaaaccaggggcttctagcagtcacttgcacctcagtgtgagtgagctccctggattcttggctgtctggtagcccctagaccccatggggcttgggaggcagagtgatggcagggctgagcctggggtggagtcagggctgtgtcaagtcccggcccagcctctgtcccggcccctggctccctgcagggtgctggattgcacaatcataccacccacagctgtgaccaaggcaggtgacacacgctttctgggagccacccttgggccgtgcagcctcgtcacacacacagggccaccgatggcatggatgcaccccggcacatcctgactgcgaggagtgactgctcctcacactgccacttccgggctgtgtgactctgggcaagtcacttcccctctctgagcctcttttcctcttctgtaagaggaggtaatatagtgcctgctcccctggctgttggagggattgactctgcccccgccatgctggccctctggctggtcctcaaatgcaccgggcatgccccacccagggcctccacctgcgcccttccctttgcttgggccggcccttgcacctccttcaagtctctgctcaaacgtcgcagctcatgaggcctttcctgcccctgacactccctccttactgaattcctccctgcatctctcagtgctacctgactcatcatggttcctgcttgttttgtctacccgctcctgggtggcagctccatctttgtctctcttggtcatcactgtgtccccagatcccaacaaagcacctcgtacaagaaagtgctcagtccatagttgcagaataaatgaatgaatgaatgaatgaatgaatgaatggaaagtgcttagctccacgcccgacccttagtaagcacctgaaacccaatgccgtgtggtggtgttagctttggctcccgatttctagccccatccaatcccaccctcatcagcccggcgcccgtgctttctctgcctggccagcttcctgctgcctgcacagtctcctccctgggtcaggacgacctctgagggaatcgtgggcctgcacggctggctccctctggctctgcctccagctcctcttacatctcccgggggcagaggcttctgggaaacaggctttgaagctcccctgggtcagacccgctggggccttccttaggcattgcctgatgtgaccccattagtgaacaaatggggacagtgagacctagagaggggcagccatgtccgatgtcaggcttcggggctcccaaaacatccagggaagcttccaggactctggcttctttgttgtttttggaacagagctgagctcaggtgcctgttttctagatgacaaaactgaaccccgttacaggctttggagccaggtttgaatctcagtcctcttacttcctggctgtgtgatcgaggtttgtcacttggtccctctgaggctcagcttccttgtctgcaaaatggcaccctaatggtacccaactcacggaggtgtttggggggacaaggtcagccatcctgcaggcaggtggggtctctggcctctcccacggggtcctgggactcctggctccggaacccccaaggcccagcccctccagggcccgcatggttccctccttgctgggataatttacagtcccagggccatagctgctgttgctttatttttttcccttccccgacttctcccttcctcaccctggcctcacttctccagaaccagcttgtttttgttttctgtttttacggctccataaatgagtcacgggtctgatttgatttaatttcgttgtaattgttatcttttcaagcttgtttttttccactcggttactcacgagaccacaaaaacctaaacaggacggggccttccccagcccggcctcctggtcccccgggactccgggccagggtcagcagctcctggagactgaggtggggtctgtggagcttctgtggggagggacttggtgtccccagcaggactgggtatcccgagtcccgggctgcagctctgttgctggacagccttgagagaattgttcgagctttctgatttccccagcatcctccttagcaggctttagaacagggaaccaaaacccaggcacctctgggccagaaggtgaaaggatgagtaaggtggcctggtgctggctccggtgaactggagagaacaggctctcctcaggggacggtggcctctgagccagcaggcggcccggatcttcccatttagtaagagaagccagaagtctgagattgtatgtgaaaagtcctgatttttaaatgttggccaacgagtcaaattaaaaacaaataaacaaaacctgactctgtggatatctgtggccccgtgggccacctctggtctagaaggttccaattctagctgcggcagccgtgttctcagtccttccacccttctgcctgagcagtcccctctgcctgaaactctctccttcttcctcctcatctcagtcactctcattctctgaacctcggtgtgtctcctgttcgcagctcagaagagatgacatctgcttcatccatgttcgccttcccaaggcgcctagttgttcccaattcacttttgtttctatgctttctcttccatggagggtctgtcttgtttgagaccgccttcgtagtgggggaaattagccccttagttgttaaaagtcataacacatatcctgcctgtcttatcattcatttctaaaatggggcacgatacttctttggtcatttaaaaaccgaagacgcgaggccgacgcctccagggatgtgcgctgggcggtaggagccaggtgtggggccaaggagtgggggcggaggaggaagccaggtccccagccagggggctgagggctgctcctccaaagcttgggtatggacatgtgaccagggcccaccaatcacatgcagccatgccagatttatgaatcagaagttggaaatgttgggggctgattgcttaggactccgttctggggtgggtggggctgcagcccggctatttttccagaagctgcagtgggccagttctgggggcagtgaccagggctcagcggtggccacagtgcagatggaatcattttgcagaaatgaccctccccgtgattatgtcaggaatgtcaagtacaatgaaaagaacactgcattgtgcagtcatgcaatttggt

SEQ ID NO: 6071 - DNA, 6267 bp, Homo sapiens
gtgctggctcccagaagaggaacctgctgcaggcgccggcgcgggcggcgaggacgacctgtttttctgacccagcccggaagcgctggtgcaggtggtctctgaatgagggttcctctttgcctctgatgtctggaaggggaattcagcaagagggactccagtctggagctctgaccccaacttcctcaatccaggccctcaaagagggcggcctgtgtcaccgggcgccggattccccggggggtgcccggggttggggcggcacattcccacctggagtgccctcatgcctggctatgccggacctgcagggtcacaccctctctctggacctttccctcccctgcacccccgcccacgccccaggccctctgctgcttaagccatggccctgggtctgtatcctgacctgggctggtcattgttctgcattgggtagtttaattacaactttctctgcgcttatctggtctatgagctcgtgatcgcagggaccctagcacagggtctgggacttactgagagatcagtaaatgttcatggatggtggacatgggtgtgtaggatgccggtctcctcccctgagaaggggcttgggcagaggagtccctagttcgccaggagcagcctcgccccacctgaccaggcctgggacaaaccaacaggttgctgtcctggaaggaaaggggtgcctccttccacctggggaggctgagctgcttctctcctcttaggccctgtgctgcaaggcgcccatacctccagtccgcacctcaggagtccttcccgtgtcctctgggagttcctgcccatgctggctgaggccccaggtctgcctgggagcagtcccacagagggaaggtggtggaggaaggggcagggatgctggctgaggaaaggccctctttcctacgatggctgtacccaggaagccggccgcaggttccctaagccgaggcagcgctggctgtagtttctctgggctcctgggctggtgcacctgcccctgccttcagaacgggcccctgtgcatggctggcatctgtgattgggggtagtgcgtgtttctgagtaatgtgaaaagagcagcttctttgacttcaccattcctagaaaatggcctcaacttgctggaagagtggggacagagggtctcagtttctcatgtgaagcttgcaggccattgtcttcagcacccagcatgttttggggcctttgagggacttgaggggctttttgaggaactctgggcatggggttttagccgaggctgaaagtggagttcccaggctgctgtgctgagtcccagctccctgcagcctcctgggtctggccacgtccacccgccctcctcctttctcctgcagttgtgcctcttttccctgctgcctcctcagccaagcccagggaaggacttaaagggcagtggagggggaaagaggctggtggccttgatgcctctaggcagccgcctgttctctgggctctgggcctgggtgcccagggaggatgagtgtcagtggatttattttgcatcagaaggaacagactgctccagatgccttttctggagtgttaggacttggggcaaaagagatgggcccatctcctgagtttagtgcctggagtttgctttagtgctaaagcaagaagtaaaaatgggatttaaagaaaccaaatggaatcacagtcatggagtgtcagacctggacgatgccttggtgacgaggtgactcccttcccttggcagagcagtggaagaaactgaagctctgagaaattcagggatgtgctagaggttccagaactaggcctggaactttcttcggggttcagtgctatgcccgaaacagtggaaggagcccgcagtgtggcacagagccccttcagagctccagcaatcttgagcttagcgtatgagtagaccctggaagccagaggactgcctgccatctccccagagttctcaggaccagtgctgctgaggtgatgcacttgaagtgtgtgtccacagtggtcaaaagttagcgctggggccctgtgccctggctcccacatctccaggtctggcctccatcggcccctccctttcctttgtggccttggccttggcttatcagtgtctctgccaggatgtcctcatcctagagggtgagctgataaggcagtctcataggatgcagggttggaaggtgcctcagggacacttcagctgagccctctgtgaaaacaccaacccctgcaggaggtggcaggcggaggggcccaggctgcactcaggctgtaggaagtttgtttctgtgtttgccctccccatgggctgcaccatcctcagtgcaggggcttcagcttccacacctagcacagtgccggccttgctggacactcaagaaaggccttgagcttccttttttcttctcgctgtggaaattgcctggaaagctatgaactgttggttcttgaatcagttggctgccccggatgtctgaatcccttggaaggaacctggaggagttggctgatgggctccaggtgcatgccaggctgtggatctgccgagcttcctagtgacctggagtctgagctgcaactatgttctgttctaatttctgtgtctctgtattctttgtaattgggccacgctcttagacagctagagcaattaatgaccttgagaaatgatcccagcgctgaatgcagaatcctgctcttttgaagtcagccactttctttgtgggtctaaacgtgtttgtgttttcccctcttgggcatgtgcctcctccttcagctttgatgctgcctctataacaacagggtttagaattattaattcctctgcacagcaaggtgcagtgttattatacaaaaaggggaaaatataattgctatcttgagtaatcattttctgaaggctgaaagtgtaacctttaattaatatttcatctgcagccagggtgggtaacttgaacagggcctaaaaatattcctgtcccagtgcatggagaaatcatgaactgtgcgacatggagccagtgtgtgctattgaattgttggcaattatttctaaaattaaaatgtttaaccacattaacccataataaaatggggggagagctatagaggtgcaactctttactgagtaggataaatgtgcaaattcctggcataatttgtctcagccacctgcattgggagagccatctcacctgcctgagaaatgaatttggggcccaggggcctggtgggccaggaagtcactgatcaaagcttggcttccaggcggtggctgtgtccaccaggcactgtgcgggctggagttggacttctacaggtcactgggtttaagggtgggatgggaagcactgtctttggtgttttccagagcggggcacttgagatgttcaaagtgcttcctgagagacggccaaagggtgttccctgggtggcctgggagtccaagagacatgtactctggggcaggaagagggcaggtgctaccggatcaccctaacaaccctctgggacctgtggccatgtgttcacaacagcagccattacaggtgtttcctgaactcttgtcgcgagcctctgtcggctccatctcatcgatcctcccagcaacccacaaggaagcttcacagagaggcagatgccacacaggccacccacccagatgcagagccagattccctgcgtggactggacgggagtttcccagctggagttctctcggccaagctgcctgtgacatggggttggaggtgctccagagagtcatggccacccctggaggaagtgacttgtggctgactgctcaaggggaagtcctgtggcagtggagtcgtcagcattaattcaaataagatctctccctgcacacaatctgctttcgtgttcctgatggattgaatcaagagtgaatgagctcctacttcgcgaaagcaaaacaaactaaacgcatcaaccacgaccgcagagcccccatctctcccaggagggaccatctgctaccggccccagcccagatgatacagttagagcctacccacagcatcctccccgccttcagacagttccaggaacagggggattctgaagggcccgcccttggcattggctgaaacgcggtgggagtattgaaaacgctggacctgtaactccacagagaagcgcctccccacctcaacaccagcactgttctcaatgtgtggtggcctctccctgcctgagagctggtcattttggcttcagggagccgggtgaggcaatgcacggccagcaggtcatttgacctcaacagcgcaggctctgccggctgcgattccatcacccctggactagcagaaccactgcctttgcaggagtctcaaaggcctgggcttttgggggtgcttctccgccactcctgactgcttctttcccttcgggggccgtggctggtgcctgctgcggggtcattgcgtgacgcgagcaccgcagcatctcaggtgcacgcgcccttcgatggccctgaggtgcccgggagcaggcgagggccgagtcttaacagctccacttcctgtccccgagtctatctgccactgctctgtagagtcctacagtttatctgtggtcagttttcttacccatttcctgccagctgctactggttttttagtcagctctgacagctacggtaattgggaaaggacgcaggctgctggggccgggtgattcaccagctctggccaacagggacaaggagcacagacggaggcaccccgtcggtcccccagggcctggtcccccaggcttcaatgagtgagacacagaaaagacccaggggcacactcattgtgaaccgaaagctgatctctgtgcacgcgcgcgtgcatgtgacataagggaattttttttttttgaatgtgccagagccaatataaatggtttcatgttttgagaagtcagaacataactccaggctgagtgaggcccctctcccggggagccccatgttttctctgaggtgtaactgcggtgagttgtctgtgcctcagattaggatactggagtcacacttaacattttatttcatggcatttccaaaaacgaagggaaaacccccattgcagcaaatgactcctccaaatagaaaactttgtgtctgttttgtaaatgctgtggaagggagttttggagctgcctcactgtcagtcatcgcccagccaggtgcctttggttgctgagtgttgcactcaggggtgggctgctggctgccgagcagtgcccctcagaggcgggggcaggaccagccacacagcctcacctgtctgggcctctggagccagcgcctccgagttttacctgactctccgggtggccctgttgcctactctagtgtgagaagcacctctctagactttactggaagctaatattaattttattgatagccgtgggttatggagcatgaaaatgatcctccaatgcagaatgaaatgacccacttcacacagatttactgccttcctcccaggcaccaggatctgtgctgggcacagcaagggaccacctggcctcgggagctaagggctctgtctccaggggtcccagtctggagaaggtgggtaaagcaaacaaggaagcctcctaataagaagttccctaatcagacatggactttgctgccaggagcacccagtggggccagcctggggcccagggaggtaagcagaaggggctcactgtagtagtaggtgagacacaaacagtttcatccatgggtaggaaatagatgagggggagggagagagttaggagatggtcatggagattgcgggtgctaagaatggccttggtgggtttggggtcatccctgctctgacactgtacagcacagtcagcttgaaccagtccctgacctctctaaggatcagttttctcatccatgcaatgggtttaatgatagttccttttgtgattgttgtgatacttcaatgagagaataatgcaaagtgcttagtgcagccctcactaagctcagtaaggagggtgactgcatctgagggcagtgggagccactgagggggtttcagccggtgagtgacgggagcagatttttttttcttgaataattcctggaaatgctttgatcatttaggccagcagaggctcttggttgagcatgagacgcatgaaccattaagattgcaggatataatcatgtgcaaattttagacaatacctgaaatcctaaaatgcatttcctttttcccatcgccatag

SEQ ID NO: 6072 - DNA, 491 bp, Homo sapiens
gacacagccaacacagaaagaaagggaaaagattccagagacgttccagcataaggccatgcagggccggctggagctcgtgggcaggggctgccgacctctgagctgggtgtgctgggagccagggatcactgggtgccggccacagaggaaggtccctgaggacacagtaccgaagtctgatcccagaggaggaaggaaggtgggccggggagaaggtctgagtgcagggatggtccaggaggaggactggaagctgcaggatggctgcagggggccgtggaccctcctggcctgaagctcactccttccccgcctcctacaggggcaggggagccagggctgcgagttctgtctgtggactctcaatggctttcactccttccctaggtaactatggctaagagacagaataatttgaaaatacgttctttttcctctttagctggatgtcccacagagaaaatggaataaatgtcatttggactgag

SEQ ID NO: 6073 - DNA, 747 bp, Homo sapiens
gtaaatcccattctatattatagcactacaaacatccttagtcattccttcatttgttcattcattcattcatgcattcagtgagtatttcttaagctcctacagtgtaccaggaggcactctgttcattgtggcattacaaagataaagattaaggcacgtactctgccctcaaggagctcccaatctaattgtgcagagagatgtgaaaatgaagcatgaaactccatcgtgaggagcgccgagaacaaaagtctgctcgaagtgaggcagaagtatggattcattccaccacaggtcccatgggaaagtgttgtgggacatccagccacaggcatgaagagaaggagcaaataaacagtaccctgaacccagaagttcttcttggctgcccccttctccattcttcttgtctcgctcttgggcctttcttctctttgccacatttactggcatgaaatgaatttgagatgtgagcttcagttctgagtcagactatatatcaagttgtgccagcaacaataaaggatggttttcacctgacttgttgaaaccattccacctggcattacacccactacgaatgggcaattagcagcaagagcaaaaggtgcgacctcatgagcagggagaaacaaggtggcagaatttcaaaaccaaggtcttccgtattcacttagagttactgtacatggtggtataaaggcctctcagtagaagcactttgtttagttcggctaaaaatca

SEQ ID NO: 6074 - DNA, 2044 bp, Homo sapiens
gtaccatgcacctttgagggaccaaggacccaagacttgaggtagacactattcccagctggatactctcaatgttgaggatatagatgcacaaaccaatgcagggaggcctccaggagccactggagaagaaatcttcagatcctaccaggcccatagctgttgcctttgtgggctcctgggttaatttccacacatcagtggcccaccttatgatatcctccctgcatgccacactcccggccatgctctgtggacagccattatttccagtaattgctaatgggagccagtctccaaagagtaatgaatcagaggtgttccttggaatgtgttacactaggacttcgccgatctcacaggctcctttccagatgagctgactgtaatctctgggaagctggatctggaggaacaatgggatgggatttgcggtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactgggccttccttgcccattgaatgctttctatacatgaagacttggagctctttacagatgacagtagccagtgaggaagataaaagaagagaaaagacccaaaatgcgggtttgccactcttttttgccagcaccgtggggacagtcactctgccttctttccaccacctccaacttcacactcacacgcacactctggtcccacagagcctgtttggtacttgcctgacagcccaccttgaaaccagatggtcatgaacctgtcaccaagtcatctgaagatcttccactgcaacctgtatggcatctgccacagggaccatgggacatgattgaagaaccactccagtgcagttgatgaaggggtgggtctgcactggagttaggtgcaccagggcctgggccaagggtgggctgggtccatcttgtgtgtggtggtcttcttcagagtagcagctgattcagagggattccatagaactgcacaggctaggtctagtcagatatcttggacattttctatttctagattagagaatatagcatacgctgattttaatataactgtgtatgtgactttttcagtgagaaaaattttaagtgatgttctaaacaatttttggcatgtagacagaatagtcaaatatctgtttaactagcaacatagttactcgtgcatatttaaaatactacatgagtatggcctggcacagtggctcatgcctgtaatcctagcactctgggaggccgaggtgagcatattgcctgagttcagtttgagaccactttggacaacatggtgaaaccctgactctataaaaatacaaaaatgtagccaggtgtggtggtgcgtgcctgtagtcccggctacttgggaagctgaggtgcaagaattgcctgaacctgagaggcagaggttgcagtgacctgagattgtgtcactgcactccagcctaggtgacagagcaagactacatctcaaaaaataaaacaaaataaaataggccctgtgccgtggctcacgcctgtaattccagcattttgggcagctgaggcgggcagaccacctgaggtcaggagttcaagaccagcctgaccgacatggtgaaaccccatctatactaaatacaaaaaattagccaggtatggtgatgcatgcctgtagtccaagctacttgggaggctgaggcaggagagaatggcttcaacctgggaggcagaggttgcagtgagccgagattgcgccactgcactccagcctgggtgatagagcaagacttcgtctcaaacaataaaataataaaataaaat

SEQ ID NO: 6075 - DNA, 1428 bp, Homo sapiens
gtctcgatctcctgacctcgtgatccgcccgcctcagcttcccaaagtgctgggattacaggcatgagccaccgcgcccggcccccgacacctagttttaaagggcccctgctgttgctgccgctgccgccgctcccagctgcccagtctggcgggctcagtcccgcgttgccatgtgtgggagaccgcgtcgcgtaagcgctggatgtggcttcgctgatgcacattggaccgggctctggactgggctaggggaagggcaggagggcggaattgggcccgagggccaggcctcgccgacccccgactgcgcctcccggtggccccgcagcgcctcccggtggccctggagtgcaggtcttaccgtccgagatcgtccgcaactgggcgagctgtgcatggggcgtggctaaggccgtggtttggttacgattggccagcgggacttaagtgttgtctctgaagagcatggacattagtctggagggtcctggaagagtgatccccgccccaccatcaaatggcgcttaggtctaggaagcgggtgtgggtggggccttagggcgaggcgcagacataccccgaagtggttggattgtataccgcaaggggctggatcgaaccccccaaagacactggaaggctgtgtggctgaggagggcccggcagatccagtgtgtcgtgggctttacaggaaagagctccaccttctctggagtgtgcagatgcgatctaggtgtgtccacccgatgggagctgcgggccgggcagatgctgccccagtacaaagctgatttggacctggggcctctggacttccctgattctctgcttgcatctccagcaaagtcctgtcccgttggctgccttcatccactctctcacttctctgccttcagagtaaaattgcaagatctgtggtgcttactgggatctgatagagtctctcggcatccactgtctatgcagcgggtgtccacctgcagcgggggccatgtgcagcggggggccacgtgcagtgtgtgcctcttcttagccatgctggacagcgccgcccctgaaaagcagctccccggtttcacccagaaagccatccagaacctcctggaaaaggtggcctgatggccaagtggcctcggatgccaggctcaatcctttgaacttttcctgtgggctgtcaggacccatagaaggtctttgagcaggtgagtttggagcagatctggtaggcaagcgaacagatggatgcgtgcactggagattccgtgggttcccctgtgtacatctcttccctttgggaaactgccctgagtgaggggctaagggcaggatttgcattgaaatcctagctttgctgctgtcagcccaacttttaggcaacagggtcttggtttgatgtgacatttccaagtccatcttgtatcacaa

SEQ ID NO: 6076 - DNA, 7176 bp, Homo sapiens
cctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctcta

SEQ ID NO: 6077 - DNA, 662 bp, Homo sapiens
acgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtctttttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcatgggccgggggcagttctctcctcacttgtaaacttgtgtagtttcacagaaaaaaaacaaaatgcagttttaaataaagaaatttcttttttccctggg

SEQ ID NO: 6078 - DNA, 275 bp, Homo sapiens
aatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagt

SEQ ID NO: 6079 - DNA, 548 bp, Homo sapiens
gacctcagcaagcggtccaggcccttgagcctgcaggaagtggacgggcagccgcagcactcgctgcatgtcgcctacgccagggcgacggtggacgagctgggcaaagtgctgacgcccacctaggttaacagacccaccagcatttcatgggatgatcttgagtcaaggaaactctacaccttggtcctaacagacccggacgctcccggcaggaagaagccccaatacactgaatggcgtcatttcctggtggtcaacatgaagggtaatgacgttagcagtggcccagtcatctccattacgtgggctcgggcctccggagggcacagatctccaccgctatgtctggctggtttacaaacaggacaggctgctgaagtgtgacgagcccatcctcagcaatggatctggaggccacagtggcaaattcaaaatggcatccttctgtcaaaagttcgagcttctcgtggccccagtggccagaaagcgttaccaggctgagtgggacgactatgtgcccaaactgcaggagcagctgtctggga

SEQ ID NO: 6080 - DNA, 697 bp, Homo sapiens
ccaacgaccaaagcaaaggacagcagaactgactgacacagctcagaaaatatccaaagctctggtcttgctctgtcacccacactggagtgcaatgccaccatcttggctcactgcagccttgacctccttgggctcaagtgatcctcctgcttcagcctaccatgtagctgggactacaggtgtgcaccaccacaccagctaattttttttttttttgagacagaatcttgctctgtcacccaggctacagtgcggtggtgcgatctcggctcactgcaagctctgcctcccaggttcaagcaattcttctgcctcagcctcccaagtagctgggactacaggaacccaccaccatgcccagctaatttttgtatttttagtagagacggggtttcaccatattggccaggctggtcttgaactcctgacctcatgatccgcccgcctccgcctcccaaagtgctgggattacaggtgtaagccaccgtgcccgagcccacaccagctaatttttaactgggctcaagtgatcctcccatctcagcctcacaaagtgctggaattccaggcatgagccaccgcacccaggatgaagcacagattcttgaactggtttgtcacggcagttggtgctgatcactccaatgaatacagcttgcctgtgccatgatctcaatctgggggcaccagttaa

SEQ ID NO: 6081 - DNA, 656 bp, Homo sapiens
acgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtctttttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcatgggccgggggcagttctctcctcacttgtaaacttgtgtagtttcacagaaaaaaaacaaaatgcagttttaaataaagaaatttcttttttc

SEQ ID NO: 6082 - DNA, 1801 bp, Homo sapiens
aatccacccctgctccggcttgcccggaggagggctgcccgggacagcccagcgcccctggccccagcctgtcctctcactccgccttgtcccagccggctggctcctggggccatcttttcaccctcctggcggggcgggggcgggggtatatctcccgaacgcaggtgaggggatcgcccgggcacttgccgccctctccagtgggaacactgggccgaatctcccgactggcagcctggctcctcaagcttgccagtgggatatcaagaagggagggtttcagtcctagcactacccctgtttttaggggtgaccccctccctccaggtcactcacctgccctggggaagtgaagaaggcagaaagcctaccctgccccgtgtgctgtctggggctgctggaccaggggaaatcccaacttggccgctgctggcacagcccccaagggacgcaggacctctgtttttcaaccataaaataatagtagccctaccttgatggtttgctgtgatgggaagagattgtaaagcactatgctccactcgggcaacagacgctgagtagttttcaaggtcgccgttgcagggtctaatagtgaccaggatgacaccccaccccttttcggtctgcctccctgggactccccctggctggctttagggaacagaggaggagaaggggttcagagaagcccagacggctgagtgagggtaggggtgggctagctctgatccctcctagcactcttgcctcaggccgcctccagagcctccctgtggcccgcgtatgggagttccgcaatggaagcattgctgtcatctctgagtccccagggcttggcccagagaggttctgggcagcatggaggaattagctcagggctgatcaacgccatggggctagccaaagggttggggagcccaggtcccatgctccttggtaaggcccctacttaactctcgcgcacaactagtccccgccccacgtatagtcctagagacttgactgggtgttcattttccatccaaaactctggcccaggaggcttcttccttcatctccctaaagctcctgcagaagtaagttactctcccaggcgtgtcatttccttcaccccagctctccctccagggcagcaccccattttgcaggctataaatagacacacccatgcaacattcgacttgccagtcactctacctccctcccgtagaggaaatgcatgggttaatcccattctggcgcattgcaatctgagtgctgtgaccaatgccaaacctggttcccaggataccagcaggaatgggcaaaactgtctaccagatagaggtgggtcaggagctaggagaggaaaggaggtaggagaaactgaggaaggaacctaactgagtgttaagcaaagtggagggcaatgacactctggaatggaaaggtgggttttggggtactttaagtgacaaatggaagtggggacttgctacagggaccaagaccttctgagcaagaataagagaaaacaagtgacccctgagtcgtgggatcctttcttggtacagcaaatagatgcttgtccttcccctgagaacctgacacatccactggaaaattcaggatgagattagggaaaggaagtttgcatctttgtggtctgataagttgaccacagtgaccctgtgaaggcaacaggacactataaaaaatgctttaaaacaaaaacttaattttaattcacagatacaggtataaatatacccgtatatgcatatgtatatttagccataatgagcatctttccatg

SEQ ID NO: 6083 - DNA, 1832 bp, Homo sapiens
gagccacctccctgaggccgctgcatcgcttccttacagcagtcaaccacagactttaattaatacaataaggtacagacaacagggtgccacggacatttaggcccaaggaatattatgcaaaagcagtgttttaagggagtttcacgtgacagaccagcagattacactgaacaaagaaacaagaagtgatgttgtccctgcctggaaatgaacttggggaggagagagggagaattattcacaaaatctccttccccaaacagtcaacacccagaaccaacatggagctcctaccccactgggacctgctgactgaattctttctgagacccagtaaggagaactggttccggcagctgagaagccaggctgtctgctaacggcctacaaggggctctctcgctgctgttagggctggtctgctctgtgtccgtggtccagttgggtacaacaaacccattcactcaacagtgccagagacccctctggagactggggaagcagcttccttgtggtcgagagctgtgcagccgggacaggagcctgcattcgttatcacacatcacggccttcggcttggctgggggccaggtgggcatggatgctggcatgcccacaggcagatctcagctttccagtgaggtagcagcctgccgcaccaagactcagggctgtcatgaggaagagcccctgggacccccagcatcctcgcgaactccctggggcttcatcatggcccatgcgcagcacacggcagacaaccggttcagcagtccctggagcccacgtgcctccccttccttttgccttggctcccttatgcccacccaccagctcttccaggctccaaaggggaagttgaagaagaatctggtacctggcccagctgccaagccccaagatcacacagccctagaaccctgctgccaagtccgtctcgggggacctaggagaggaagtccgccagcctgggaagctgcctctccagccttggccaagcaccacctggcaaactgcagctgaaatgccgagcacactacagggggataccccctccaccccagccctgctgagaagcccagccgcactcttgatctccctgaaatccttgaatctaggtcaagggtggtgctaggggttggatgcacagggaagaggctgagcaccaagacatgtggaccagtcaggactagagacctccttccttccagacatgcacactcagccacgctggagatgacaaaaccttacacactcaaagccaatacatgcgtaggggcggccacatgccacgcactgttctaaatatcttgtacaaactcagctaatcctcaggacaattctcattttacagatgaggagaccgaggcacagcgtggtgaagtgacttgttcatggtcacataggtggtaaggcagtgaggtggaacttgaacccagacaagcagcctccactcccccgacctgctcacctctaactcaggccgctcttcgaagacaacctgaagatttttctttgcaatcgatagtctagagcaggagtctccaaggggagagaccatgtcccactgggagcccaaagcactccagggagggtaggaaaaaaatatgagagcttttgtattgattttgtttcctcactcctgtttccttctctccccttgtgggtgagggcgagtgagcagttgatcatctcttaaaccagggctgccagagccagagccagagccagaaaatggagtgccttccttccttcctttccttccttcctttccttccttccttcctccctccctctctttttttttgatggagtctagctctgtcgac

SEQ ID NO: 6084 - DNA, 532 bp, Homo sapiens
tctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaaggttagcttctatgagtcactgatactctttttattgctatttctaaatttccttggcttgaaaattacttctgctttgcagaaattatctgcttgcagctgtggataatttataacaatctctggtgaaacctcagaaaagagatatgcttttgtcttagatggatgtcagcagctgctgcagaacccggtgaaaacaccccccgggtagcacgaggctctgcgagccgtaactcc

SEQ ID NO: 6085 - DNA, 562 bp, Homo sapiens
gaagtgggaggaggaggaggggaaagcgggggctgcgggagggggaggtggtagttgcggcgctggttcccgggagcagccgtcgagccacaactgcggaggaggagttcgggaaagcggccgtcgggactcctcccctccgtcgtctccgccccggttgagaggcgcctcggcgcatcggagggaccctcccccgcgcttcctcaggctgctgtcgccgctgctgggagatgggcctactcgcccgccaccctgcgctgccgccgctctgaggagttaaagggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcactgtgtcacccagggtggaatacagtggtgtgatcatagctcactgcagcctggaattcct

SEQ ID NO: 6086 - DNA, 1203 bp, Homo sapiens
agtgccagcccgtggccacctcagagcttgcacaggctgttcccactgcctggaacttgctcatcctgcacttggcttctctcggctttagctggagtcaccctgagcgtcccctcccctccatcctgtccccagggacacacgctcccagagagcagttgctgagtgggcctccccgcctcttccataaagccagatagttggtgactgtccttactgcaaaccctggttcacactggctcccctgggagggaggtggtttgggcccacatgccctgtgttcctgctcagaatgggcgttagaaatgctgccatagcctgtgccactgcagtggaagcatctttaggaaacggcttatatcttaagacaaacttcagatgcgtggggccagaacgctgtgtccatctgcatctttgctgagggatcaggtagcctggagtttgccctctgctgtgttggcttgaagctcataggagacttaagatgggctctcgagcaaccaacgttctgtcctttgccgtagactgtgaggcatcctgtgtgtgtgaagcacccgccgtcagtcaagtatgcctggtgctttctctcagaactcatcaaaaagccctcgggaggctcggtcacactctccgaaagcatggccatcatctcccacagcaccacgggtctggtcacatgggatgccgccctctacattgcagaatgggccatcgagaacccggcagccttcactcacaggtctgtcttagagcttggcagtggtgccagcctcacaggcctggccatctgcaagatatgccgcccccgggcatacatcttcagcgactgtcacagccgagtcctcgagcagctccaaggaaatgtccttctcaatggcctctcattagaggcagacatcactgccaacttagacagccctagggtgacaatggcccagcgctggactgggacgtagtgacggtccatcagcgctctgccttccagctagatgttgtcattgcagcagatgtgctgtattgcccagaagccattgtgtcactggtcagggtcctgcggaggctggctgcctgccgggagcaccagcgggcttctgaggtctacgtggccttcgctgtccgcaattgagagacgtgccagctgttcaccaccgagctaggtgagcccccaccccagcctgggcctgtatgtccctgagctgtcac

SEQ ID NO: 6087 - DNA, 367 bp, Homo sapiens
gggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcagatcctctgtccctgtgaaccctg

SEQ ID NO: 6088 - DNA, 2379 bp, Homo sapiens
gagatagagtttcgctcttgttgcccaggctggggtgcaatggcaccatctcggctcacagcaacctccgccgcacgggttcaagtgattctcctgcctcagcctcccgagtagctgggattacaggcatgcgccaccacgcctggctaattttgtatttttagtagagacggggtttctccatgttggtcaggctgatctcaaactccccacctcaggtgatccacccgcctcggcctcccaaagtgctgaaattacaggtatgagccaccgcgcgtagcctttacttttctttttttgagacagggtctcactctgtcgcccaggctggggtgcagtggcacaatcacggcttactgcagccttgacctcctgggatcaagcgatcctcctacctcagcttcctcagtagctgctactacaggtacactgcaccatgcctggctaacttctgtatttttttggtagagacaaggtttcactatcttgtccaaggctggtcttgaactcttgagctcaagtgatcctcctgccttggcctcccaaagtgctggggttacaggcatgagccactgcgcccagcaagggcctcagtttcttcatgtcaaatgccacacatgcaggacagacattttgttagcaccttctggttctatcattttcgtaatctgtaactaaacaataatttatgagttaatgatgttattgagttttaagtttttggttgttaaaataaattcctagccaggcacagtggctcatgcctataatcccagcactttgagaggccaaggtgggtggatcgcttgagctcaggagttcgagaccagcctgagcaaaatggtgagaccctgtctttactaaaaatacaaaaaaatagccaggcatggtggtacacacctgtggtcccagctacttgggaggctgaggtaggaatatcgcttgagccttgggggtggaggttgcagcgattctcctgcctcaccctcccaagtagctgggattacaggtgcgtgccactgcacctggctaatttttgtatttttagtagaaatggggtttcactatgttggccaggctggtcttgaactcctgaccttaagtgatccacctgcctcagcctcccaaagtgctgggactacaggctcacgtgcgccactgcgccccgtctgtgtttctttaattgagaataaaattaccttcagttggttggtctggtctcagaatcacacattggtccagaattacacttgccctgctctgaagaagaatgccacctgagagcacaaatgtatagaaagaaatgtacataataaagccatcacagaagcagatatgatgggacagatataataacagatgccctttcaacttgatcctctcatgctaggcctaaaataaaagagttagatttagtgtgtgtatatatgggttacgtttcagaagacatgaaattggtctaaatctaaataaaaatgagctaagctctgcctaggttcatttacattcatctatcaacagccttgcagagatggttatgtaagtgctacgggatggttccagcacttgtttcaaagggtctttcagtccattcaagctgcatccaaaaatagttgaggctgggccctattctgtactgcctgtggcttcacaaactgaaaaccaccatatcagacgtggttatgccctaccttgctcggctttctgggttagatcctctgaaatttcattttatgagtattcctgattaccaaatgttcagaactcagctcctgccccacaaattctttatgacattgcataaaaccagtgacagtgccacatccaggcaggatgaggaccacgcactcctaactatggagacaggaatgctggcagtgctacttttgaggtcactgttggccaagataattgcttcactaggcaaaggcaaacccccttaagtgagtttcctgaggactcagagaggaaggccacaggtgctccaggaggaggatgcaccatcagggaccttggacaatgacagcaagacagtgagaagcctctggggaccattctacaggggacttcttccctggccgtgcagctgacaggccccaggaagcagagtccctgggctctccctggcagctctcggtgcatttccaggggaacagcttggcagccccgtgctgggtggtgcgctccatctatttctatggtacctatcaccatggtacctacttgctctgaaaaacacagctaaaaacagaacataaagaataggagcacagtccgcttccctgcagtcaccttctgcagctgttgttatgcctcaagattgctctcatgggcccccttccattctgagtttccatgtttttgttgtttgtgaccttc

SEQ ID NO: 6089 - DNA, 546 bp, Homo sapiens
agatgctggcaccgaagccggggggacagccggtgtggaggacggagagcgccagtgcctgagggttggccggctagtagcgggaaaccagcttctctgaccgaagctctggactccgctgatccggagcgctaaagtgtgtccggtgccaccctgatgctctcctgggagttatgttgctcctggctgagaaatagacttacctctttcttagatagcgttcctgcgagtgattttcaggacgctggatgctaagactagacgaagcaagccaaagcccccgcgagccaggcaggccggtgtcacggccctatgattatggcaagggggaccctctgcctggctgctgcttcctgagacccgttcggaacctcacgtgtacctcgaagctcaccgttttcctcgcaaagaacctggttaaatgtccataatggctgagttttattttggaacataatttctttggttcttcaccaccactttttggagagtggtaatgtcttcctctttttgctttaggagaaaagtctctcgctctgttgccca

SEQ ID NO: 6090 - DNA, 542 bp, Homo sapiens
ttggatttcctttggcagggttcccttgtatggaagttctcaggagaacaacactctcagagtcccactgtctcaaagaattcttaatggacaggacagattccaagcctcttggataagactgaagccctccatcacagcccatcaatccgtttcctggagttcggaaccacagccatgtgcctcatcagtgtaagactgagtctcagctctcacttcaaggaggactcaagacaagcaaaagaagtaaacttttgctgggtgcagtggctcacgcctgtaatcccggcactttgggaggccaaggtggtggattacttgaggtcagcagtttgagaccagcctgaccaacatgatgaaacgttatctgtactaaaaatacaaaaattaggctgggcgccatggctcatccctgtaatcccagcactttgggagaccgaggtgggtggatcacctgaggtcagaagtttgagaccagcctgggcaacagaatgaaaccccatctctactaaaaatacaaaaataaactgggtgtggtggca

SEQ ID NO: 6091 - DNA, 2883 bp, Homo sapiens
ctgagacaaggtcttgctctgtcacccaggctagagtgtgctccattatcacagctcactgcagccttgacctcctgggctcaagcaatcttccggcctcagccttctgagtagctgggactacaggtacataccaccatgtctggctaatttttgtattttttggtagagacggggttttgccatgttgcctagaactctaggcaaaacatgttgccttgaactctaggtaaaacatgttgtcttgaactctaggcaaaacatattgtcttgaactctggggttcaagtgatctgcccgccttggcctccccaagtgctggggttacaggtgtgagccattgtgcctggctcctcttagctgtttttttcttttcttttttttttaaggcattctccctcccaagtagctggaattaacaggcgcttgccatcatgaccagctaattcagctaatttttgtatttttagtagaggcaggtttcgccatgttggccaggctggtcttgaactccggaccttaagtgatccatctgcttctgctgtccaaagtgcttgaattacaggtgtgagccgccgtgcctggccttgctcttagctttttgaagggactgcctcatctcataaagatttgtttactgtgacccttgcctttaaaaatttccccaattttgaactgttgagtcagaagccttgaaacctaggtaatttttgctctcaggttcaaagaaacaaaatacatttatctttaggttttttttttttttgtttgtttgagaccgagtgtcactctatcaccaggctggagtgcagtggtgcgatctcagctcactgcaacctccgcctcctgggttcaagtgattctcctgcctcagcctcccgagtagctgggactacagatgcgcatcaccacacccagctaatttttgtatttttagtagagacgaggtttcactgtgttggccaggatggtctcaatctcttgacctcatgatccgcccacctctgcctcccaaagtgctgggattacaggcgtgagccaccacgccggcctgtctaggttttaaggagtggctttgaaatatatgagcagaatttaagacttatcatttttcagagatgagaccatgatagttcatttgtagtgtgtctttgaggaggatactaatgcagataaatatccacagagctttaattatttttggtgttacaaagtttatctgtgtgatcttgttttccttctatgtaagaaaaacatgttatatagatcccttgcaaggacgttatttactgaagctcttagaaggatgctaaacttgaggctgtttcaggtgagtatcctcaggagagtgttgaaattgtttctggaacactggctaggttgaaaactacttgaaaaatgcacttacctgagctgggtgccttaatttttttcttttaacttgactggtagtttcacatttctattaagtacttcctgttaagtacttctgagtacttaatttgctgagaggacagtagtctgtttggggatagcgctagattgcagtggtagctcaaattgctcatcttttacctgtctaggtgattgagacctgtattttgtactttttgacacagcagtagtgtaagacagtgcctgagtaaaacttaaaatttaggagttggctgggcacggtggctcacgcctgtaatcccagcactttgggaggctgaggtaggtggatcacctgaggtcaggagttcgagaccagcctgaccaacatggagaaactccgtctctactaaaaatacaaaattagcctggcgtgatggtgaatggctgtaatcccagctactcaggaggctgaggcaggagaatcgcttgaacctgggaggcggaggttgcggtgagctgcgatcacgccattgcactccggtctgggcaacgagagcggaactccgtctcaaaaaaaaaaaaaaaaaaaaattaggagttacttacatgtctattacgaaggctaatgttttgtgttagataagatctctgtctgatgtatcctatgttacttacagtatgtatatgtatccagagcagttaagagtttcagctactatttgaccttgggaactttaaaatggacttcacgtttatataaacacttatttttcttgttttgaaaagaaggtaacatcaacctcctggagatgggatgaggactaaatgagatgaatgttaaagaaactgttggccgggcacggtgactcatgtctgtaatcccagcactttgggacgccaaggcgagtggatcacctaaggtcaggagttgaagaccagcctggccaacatggtgaaaccctgtctcgactaaaaatacaaaaattagctgggcatggtggtgggtgcctgtaatcccagatactcaggaggctgaggcaggagaattgcttgaactgggaggccgaggttgcagtgagccgagatcgagcccttgtgctctcgcctgggtgacaagagtgaaactccatctcaaaaagaaactgcctaggccgagtgccgtggcttactcctgtaatccagcactttgggaagtcgaggtaggagatcacttgagttcaggaatttgagaccagcttgggcaacatgatgaaaccccatctccacaaaaaaatacaaaaacgacctgggcatggtgacttgcgcctgtagtcccacctgcttgcggggctgaggtgggaagatcgcttgagcccaggaggtggaggttgcagtgagccaagatcatgccactgcactcaagcttgggcaatagaatgagaccctgtctcaaaaaaaaaaaaaaaaaaaaaaactatgaaaagtattctgtctttgttagtgctatctggttcgtaggattaggcg

SEQ ID NO: 6092 - DNA, 6186 bp, Homo sapiens
agaaagagtgctttcgccgtgggtgcagagggtgggcccgccgggttgggtggggggcgtgtgatgacggtaatggcgacgagatgctcaactcacgcggcctcttttaatcctcacagcagctctgcgtggagaaactacagtaacgtgttaccacgttaaggcgggaagctgaggcatgggagtatttagtaacgttcccgggccgtagagctgcggtgtgcggccgcctgatccacctgatctgtatgactcccgtactcaaccagcctatgtttcctaccagcgaatttttttttttttttttttttttttctttttttgagacaatctggctctgtggctcaggctggaatgcagtggtgcgatctcggctcactgcagcctcgacctcccaggctcgggtgatcctcacttctcagcctcccgagcagctggaaccacagtcgcctgccaccaccaggctcggctaatttttgtattttttgtagagacggggtctcgccatgttgcccaggctggtctggaactcctggactcaggcgatcctcctgcctcggcctgccaaagtgctgggattacaggcgtgagccaccacgccgggcctttccccgggaatgctgtggtagagggacccgcagaggccccgaggctgcctgcatgtgtgtgttgggaggatctgcgctgagggtgattcctgcgtggatgcctgcggggattcctgcgtggattggggaagtcctgcagcattacagaattgttacccaacgccagggccttggtccagagtcctgttgctagatgcacagaaagcaaatcactgagatgaagcggcccaggccttggagctgcgcagcccggaactcagctggccgcgtgcgccccgcgtggaaggcctcccgcagtcgccgcagcgtgtccccaagggggtccatcctgccagatggggtggcatgaactgggtggccagggctgcccctccttcatgggcaccacccagccgccccagggtctgggcacccctgacctgcctgcacccacaggggcttgcagacacctctaccttatacacacacagggacccactcagatgaccccacagggactgaggctgcctgcaacccctttcacccaacagtgagcactcccagacacacatgaagaccctcgcaccactcccctctgccatggacctggaggcggctgcaggactgggtgtgggcttggggacagctgctccaccacagcccccgagggtgagcaggcaggcagagcgccatgcttcttcctgccgcacagaaattaaccccaagccatggcctctgccctgccctgatgcccctcctggaggcggggcagcctcacccctgccagtctgaatggtgtaagcaggagcttgatgagtagagggggtgactcactgccaccatggccaccaccttggagcactccagacacagaattctccgtcttcctctgtccccagcctgggggcactgcccagggaggccaggccagtgggcaatagcctcttctccctgtgcctcagcttcctcaggaagagggggagaacacctcgggcctcctggaggccctgctgcccaccctgccggggctgtggtgctgggaggcagaaacagctgtgggggagaggatcagggcgggggagagggcgttcctgcctccgtgctggtgccagccagagctggcaggcagggtaggggcctagacattcccccgagccctgcctgtttacttgaagttcatcggaggagcactctgacgcactcgttcctcggcctggtgccaaggacccgtggtgaccctttcctccttccctctccgagtccctttcctccagatctcagcttggctgatgcttcctccaggcagcccacccagattatgccctcatccactgtcacagtggccccttgactctgctccccagcgttctgagttgtgccatgtgataaatgtctggttacactctacccacctcccaaccctgtccacatctcccttatttccccctcattagactgggaggcaggcccctctgtgcctacttatttgagacctagtgcttgaagcctctcatgttaccggtgtaatgatggcacctgccagctaatgatgagaccacacagtcggttctgagcccagggcccagcatcggtgagcgcaaggctgtgggtgattgttaagtggccaccttgagggcgggacctgctccggtctgcaggatggccctgctggaccagtgtgctactgagagcctggtcaggagccccaggccagccctcagctggagtgattgtggggccaggctgaacccaccatcttcctgctctgattgggagaagctgggcagtggcccgcacacaggacaggcaccatggtccccataggggatggctcgtcacgggagcaggactgagacccaggagccaagaacgagcctctcgagccaccatcaggcctgtctccgggctctgcctcttactggttgtgggaccttgggcaaatcactcaccttctctgcctcggtttcctcatctgtgaaatggggatgctaatggcacctggtgtcattgtgaggattaaatgacatcacgctgcataaaacatttgctgttgtgcccacagaaagtactcgacaaaggtcagctctgggtgttttgctaagtagcctgcaaatatttatctccctcaactccgcactctcctgggtccttctccattctactctcaccttcagacttctgccagtggtcaaaggcaaaccacgcctgtgcctctctcaccctttgtaagaatctctgcagaaaccacaaaaatgcaaggcacgtaacgtgaatggtggactgtgggccgggagctctgtgggggatggagttctgcagggaacattccagcaaccctcctagcaacgctgaaaccaactcaccagggccacaggacacatctctcccacagggcaaccagccctggcattgcccctacgggtcactcactctggactgaggcccccagggagtgcccagggcaggaccctggcaagcggagaagccaaggccgccttctgcctgagattggggggatcctgggcctgttatctcccgagggtgctgggcagccattgtggacacacagaatagggaactcctgaatcaggcactgggctggggtcccccaagcccacccccgcggcactcatcccacagtgtgaggttgtaaggagtgtgatccccatgcctgccctcgctcatttcaccaccacggccgcccactgagggaccactattcaccccactgaaggagatggaggctgaggctcagagagggccagagcttgcctgataccacccagctcctcacattggaaaacccaaatccagaagagcagaaggctatccacctcagctcccacctccctcacagtcccctggggatgggcagccaagtccttgggggaagggacactgggctggggcctggacggcagacccaaggctgggtggactccggtaggccagctgtgggaggggtgaccggtgaggggaggtctcttgctgtttggattccatttcctcggcctccctcctcactattgctgccactccccacactgcttaggttgtggggtctgagactgcctcttgcctcctgcggctgagccactgaggtccaggggctgatgggcccaagggtctctggggcgtggccccccatcacaggttgaggtgcatttggcccagacctgcagcttctggggtgggggggagttgccacatcatttggtgatgaagatagcggctgtttcctctggcctgggggccagggcaggaccagccacttcctctcaaggccacgggcctctaaaaacaatactcaggtgcccatgtgctgggcactatgccagcctgggtgctcgctgtgggtgcccacaggctccgggaacagagtggggaggaacggggctgacatatcacagggagtgaatggctggccgagccgctgcccccaacctcacagcagggaccgtccctgggcagggactccctgctcgttcacaccctggcctatcaagtgggttggattccagggaaacggaggctctgcccgttctctcattcttcctgcctcagtttcctcatctacaccatgggccttctaagagcatcctcccagcatggcatggtctgggggcccaatgacctgggtttaaactgcagcaaccacatgtgtgagtggggagaccttgggcaggttgcttgacctctttgtattcacgtttcccatctgtaaaattgggcactgcctgtggcacccataccactgtcgggagaattcaagcactgggaccccgggaagtgctcagtatccatggaggacggatgtaccagaggagggctcagggaggagacccctggggcaggggcctgaaggggccttgatccaaggtgggtgttggggagacaaggacatcaccctgagacccaactgaggacagggatgtggtgacagagggactgaacatggtgggtagagggcctgggggacccccatcagggcagccagaaggcggggatcactaggccaacttcaggggacccacaggcccaataccgcagggtctccgattctgatctcctgcagtgtagcttcattaaacaaacatgatgagaggctgtgattttgaactgagctcctgtactaggccccaacagaccagaccaaaccaaaatggaggcactcatgccaaatgccacatcatcaaaccgaagctttaaggaagcagacagagcccaaaaccacagaccagtttctccgggaagcaggagattccagtccacctgagccggcatcatcaggtcccctctgccttaccccttagaaaaaagcagtccgcttagaaaaaagcagtctgcagcgatccggtattaggcggtttggtgtttcctatttttctgtttcctcctttctgccttatgaaccccctgctctgccactgcctggtgggagctctcactccattttgtagaatggaggctgtccggattcacgaatcatgaatagaagccaatttgatctataactaaatgtgttgtcattttgtcttttgatggccttaagctggattttcatgaggcctcccaaagctcagcagcccctcccttggggagccagggaccagcgtatcccctcattggtggctcgggccaacccagccccgggtcacaaagaggctgaacagcctcggctccctgatggggcacagttcccgggatgagaagtgcctcctgcaggcggggcggggctggctggccactcctttcttggaccctgacaaagtccattgctaagaatgattctttcccagagtcattcatggccacatccctgcatcagcactgggcatgcaggctggtgcccaggaaacggctgttgctggaagggatacttgacccctgtggggaaggggcgcacagtccttcctggggcagctggacccagagctgttcccttggttcccttggagggtgtccgggaatcccaggaaaaggaggcggtggcaacccagctcggacaacggaagggtgcctgctggccaggggggtgcccgggacctcgctgccactccccagatctgcctctcctccttccgctttctcccccagcaggcaggcagatgagctcagccaggacacagtggcctctgagtgcagctgccggtggctaggcccgcctgggctgcctgtaacccggagttgctgagctggactctggcccgactgctggcccactacagccccagcctccccgggatactctacctgaggctctgccaagctgcccttcctcctggctgtcccgctctgcctggtggccctgctgttaagaaatgtccaacgcagggccagtccccgggggaggggtggggcggagttgccctagcctcgtgcctgactctggctctgggcgggctggaggctgcaagccaagatttcaccaccgcctccctcgggggcctcgacatctcctcccagaccacagagaagaagtcaacgcccagagggcgccaggctagagccacacagcagggctgagctccgagctgaggggcagcctgaggaggaggaggagaggctgtgcagcagggctgagcactgagctgagggc

SEQ ID NO: 6093 - DNA, 3092 bp, Homo sapiens
cttggccccccacagtgcaaggattacaggtatgagccaccatgcctggcccctaccctgcctattgagaaccaaaagaaggatccaaattctccttagctcaactcgagccatttcctgattgcttcatcagcaaggagctggttattgggctgtccaggcctcccaagcagcacagaaatgaggcgaaggagttttcctgctgctccactctgtaaggagttagagggtgatgtttgctcgtttgcagagagagatgccttgtaggcacctcaggatggagaggaccctgattccaatgtcctttttttctttagaaacaggaccttgccctgtcactcaggatggagttcagtggtccaattatggctcattgtagcctcaaactcccaggctcaagcagtcctaccatgtcagccttcccagtagctgggaccacaggtaagcatcgtgacactcagtgaattttgtttttatttttttgtagagatggggcctcagtatgttgccacggctgaccttgaactcctgcactcaagggattttcctgccctggcctcccaaagtattggtattacaggcatgagccattgtgcccaccgtctctggttcttaaccttctacttccctcttccagttttaaagaatgcttgtaattacatgggctctcctagatactccaggataatcttgttttaaggtcagctgatgagcaacattaattttatctgcactcttaattcccccttcctatgtaattgtgctgtgtaacataggacatgagcaattggtgggggtgggggttattactttggccaccacagtattttatgccaggtactcagctaagcactggtgaattaagcatgaataacacacactccctaatctccatccattcatgggaggagcacctcacctgccatgctcctgagaatctggggagtcaaagaagtcttccatgaggaggtgatgccaaagcggacaagtgacagagtcgaagctagctaggaagagagtagaggtttaaggggaagcgtattataagcagaggatatcacccacttcagagactcccagaggagaaagagtgtgtgttcaaagggcagatgaggctcagttggactccatagcagatgaaatggagaggggcaagcaatgaggctgccttgcaaggcagggcagagcaggggctgttgaagggtttggacttaatccctgaggcaaggagaagtgatgtaaatgggggagtaacatgatgagattaatggattagagacatggctcaggctgctgtagagaaggcaccagggagagcagatggctcaatgggtgtgtaggagacctctcactgagtttagggagaggtttttaaaacagaagaagtttgagtaatttaaatgatgatgggaaggagctaaaagtaggggataggttaaagatacaggaaagtgggaggaagaactgacaagtgaggttccagagagggcaggagaagaggagattcccatagggggattaacactttcttttcttttttctttctaagacagggtctcactctgtcgtccaggctggagtgcagtggcacaatcttggctcactgtagtgtaggcttcccaggctcaagggattctcccaccccagactcccaagtagctggaactacgggtgtgcaccaccaccacacctggctaatgtttctttttttggtagacacagagtctcactattttgcgctgattggtctccaactcctggcctcaagcgatcctcctgcctaggcttcccaaattgctgggattacaggcatgagccataatgcctggcctctgctagttctgtattctctagagttgtctttactttgtgctagcgtgtccctcattgtgctaatcctctgtaaaaattaatacctttttttcttttcgagatggagtttcactcttgttgcccaggctggagtgcaatggcgctatctcggctcagcgcaacctccacctgccgggttcaagcgattctcctgcctcagcctcccgagtaattgggattacaggcatgtgccaccatgcccagctaattttgtatttttagtagagatggggtttctccatgctggtcaggctggtctcaaactcctgacctcaggtgatctgccttggcctcccaaagtgctgggattacaggcatgagccattgtgcctggccaaaattaatactttttatattaaatttacatatatatacatttttttctttttgataccgggtctcacactgtcacccaggctggagtacagtggcataacctctgctcactgcagcctccacctgccaggctcaagcaattctcctgcctcagcctcccgagtagctgggattacaggtaagtgccaccacacccagctgatttttgtgttttttgtagagacgaggtttcgccatgtttcccagactgttctcaaactcctgagctcaaagcagtccacccaccttggcctcccaaagtgctgggattacaggtgtgagccaccttgctcattctagtttaaactttggagtggtttgtgtctcctgattggactcctgcaaatacagaattgatgctaggaagggtaccaggagatagacgcacacagatgggatttgggaataggtttggttatccaaggagcagtgctgagctccttgctaatgggatatgggatgctggtgatttccagtaagtgacctcaaaattactcaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggaggtgagcagcaggcgagtgaagggaaacttcatctgtatttctagcccctcccatcgcttgcatgaccacctgagctccatgtcctgtcagatcagcagcagcattattctcatagaagcacaaactgttgtgaagtgtgcatgtgagggatctaggttgtgtactcctt

SEQ ID NO: 6094 - DNA, 1313 bp, Homo sapiens
gggaggccagggacctcactgggctgggcaggtgcaggccaccgccgtcccagtgccctcagaggcacctagactcatgtggacccggccgcagaccgttctgggcagctctgtccaggccggccctgccctctgacctggggccgcaggggctggccactgtgggctcggttccctgccaccccaattcatctgcaccccaaggaaagaaaatgaggggttgcagcgccccaggacccaagagcccccgaacaccagggcagcacatacttccagtgccagggccacagcagagcggggccaggcccagcccagtgacgcagggcagacggaagggcgccctccacaatggaggggcgcaggagctgccgcggccaggacaaaccaacctcaggctgacctaggccggtaatgggtttaacgcatcaggtgcaaaagagaaacaccccacaaatcagggagaggagggaagccgcccaccccatgggaggaagctgaggagtgaacgccagggatgggcagggccggtcctcggagcactgcagacaccagaccaagggcgactgtcatcaccacgagaaggccccgtccatggcagaagccaacctcaccgcgccgactgcaccggagacgcccacgaggacagccggcctctgagaacgcagctgagccgtcacaggtcgccatcagcaaaggcaagagtccagattatgcaaacggaggcaaggctgccatggactccagagcctcagacgccatcaacaaaagcaaagtggacacatctgcatcaaatccatcacaaagacggccttccagactccgggggaaacggagtctcgctctgccacccagactggagtgccttttcccctcatcgtgtgggagccgccgggcgacatcccgccccggtttccctccactcgaaggcagtcacctcggttgccagctcctgcctctgtgatgatccccacgagggctgcagagtgaagggcacagcagggttcggcctaactccccggggagccctaggcgagagggcttggtcctggggagctgcccaggtcttctatatcccctggcctccatccagtcccgcacgactcagctcctggccctgtgcaccgggcgacgcctgctaggcgcatgaccctcagagtcaggcctgtactcacctcagcatctatcaagggccttcaaggatcgggtttttttaatcatcgtcaaatatatcgttactaaaaagatacgtacactttgggaggccgaggtgggaagatcacttgaggtcaggagtttgagaccatcctggacaa

SEQ ID NO: 6095 - DNA, 2055 bp, Homo sapiens
taccacctccttctctctctggcccccttggtgtgtgaggaagcacaggaatggatgtggaccaggcatgccctggagccagctcatcccagcttgcacctgcccaccagagctgatcgtgcccgtctctccccagctctggcccaggggcatccccttgaaggtgtggaatcagccaaaatgggattgttcacaacacagaaatccgcacacgccgggatcagggcttgttgttccagagagcctgatgttaagcatttatcagcacagacctggccgtggctgctgacgctgctggcccctgtttgtggagtgtttgcacgtgccaggcaccgtgctgaggaagcacttttcatggattagctcattgtttgggatcttcgcacagctctccccgagcagggtgtattttgtcatcctaatgaataggaattgtcacaagaccagtagagcttgggcagtgctgatgggagggagctcagcaacagtctctccagggggctgtttctcctccttggcctccgcaactctgggcagggggcacaggcttgggtcgtcaagcaacttgctgcagtcacaccactagacacgacagagccgagacttgaacctgcacctgtaagaggctcagcccttgtcggagttcctgtgtcacacggagggcttgcctcctgcctgctttgcacttgggtagactcaagctccaccagcatcagggtggctggtgtggattcgtgcagtccagggttcaaaactctgagtccctgagctcactcaccagagcctgagtcctcaccacacttgctactggaatggatcatttatgcaaggccagagattgctccagaccctgacctcggagagcagctgatgtttcgtagatgacttggggagcgggaggtggtcacctgtagcgtgatccggatctcctcgaacaagggtgaaacaaagcggttacatgcttgagtgtgtgtgtgcgcgtttgtgtgcctcgaggcagaaggtggatgttcgtgcttggagagagactctagccttcgtcagaccccctgaaccgtcagaggcagggtcactttggagagagggttgtgggttctggtggggaacgcacgctgcacttcggcccagcctggggtggaggggtagccaatggggaactcagaatggtccggtgttgtggtttacagcaggggtcagattacctgggttcaattcctggccccgcaccacatgtctgtgaacactcaggaaagtttttaacttccaaagtctcagtttcctcatttgtaccatgagatgacagtaccgacttcacagggctgtcttgtaaggactgaatgagccagtccacacacaggactcagagctgtgtctggcgtccatgaaacaccatagcattactgttctgttagcagaccgagaaaggaggtgagagccgcagtgatactcatgagggatgggagggctgccttgggctgcattttattggaaaggactggatgatggcaatggtaatgataacaataataataacgatggctgcatttctgaccacctgccatgtgccaagcctggttctagatgctctacaagaataatttctggtctttaaaacatccctggaaaatcagggttattgtccccattttacagatgggaaaattgaggctgagatgtccaaagactcacagctagtgtggggtggagctgagaaggttttgtttcacccgctgtgatgtttagcctaggtctgctgggtgccgtttaccatgatcttctgccattggcaggagaaggtcatggttaaatgcccagacttggaagccaggctaccctgggtctgaatgcacttcattgtgagatctcagggtctcgatttttccctctgtgaaatgggcataatgataggtgccacctcatagggctgctgtgaggaccaaggagagactacgtggataacaaaagccaagttcctagaacagtcctcatacacaggcccccagccagcccccaccatcctcactcccaggcctccaaccagttcatcccattccc

SEQ ID NO: 6096 - DNA, 3857 bp, Homo sapiens
gcgtgcgaatgtgtgagcatgtgtgagttcctgcgtgtgtgacttcaggcgtgtgtgtgtgtgtgtttgtgtgtgtgttggaatgggggtggggggcggtcctggaaaggccgagagccttggaatctgaggagtctgcagcccattcttgatactgctttactttccaaaaagttatgacaacaaaaccaccctggggcccagacctggaagccgtcagctatggaggaccctggaagcaggcagagaaaggtttggagttttcagtgcgatgacaccagcgtgcctgcggaagtggctgtgtctcctcttgcctccttccccacccaattccgccccaggagcccagggatggaggcccaggagacggatcccacaagagccagcacccactccaccccagtttgtgttttctagaaccccataagattcggatgcagccagtgggggacaggaacttcagcaggggaagccgcagccctgggtgtagaccccatccactcgtgcctgatgcagccctcctctcaaggaagggcgagctcactgaaggggacaggtcacaggtcagcccaattcaccctgagcacagaaatgcacactgcatttaggacggccggattgctggaccaaacctgtctctctgtcccctgcacacatatgcacatgcgcatgcacagagacgcatgctgaacttctacggaagaggagagcggtaggaccaggctctccagggtcctgccttggggtctctccccacaactgtggcataaacctctctccagaaacagagggcctgataacccgtcagctccccagaatccgaatcctaaaaggctctccccagggttcgtccggcttcagcagagacccttcccacccaggccggagccctgcattcagttgccagggacaccgtgcagtacggcccccagcaacctgaagacatcaaggtcccatccccctgcttccaagctgccaaccttcctcatttcctgggtggtgggtaaggggcagggggcatggggcagaaagagatcctccccctctcttggggcttcctccaccagccccctccccactgaagctcccttctgaaggaggctggagagctgctgcggagagaggagcccatgtgggatgccctcccaacacacacaggctgatcacctcaccaaatccttattaaaaccatccctgttcaaaggcaaaatcagccaaccaccagtgtccctctgacctaatgtccagcagggcaagagctcaatgcctggatgtcacctccagggcctcagcaactgtgcatctctgctcaggctaccaaacaaaacaccccagacttcgtggcttaaacacagaaatttattttctcatagttcttaaggctggaaggccaagatcaaggtgctggcagggttgatttccgtggagggctccctgcttggattgcagacggctgccttctggccgagagctcacgtgacggagacagcgcactctctggggtctcctcctgtgaggacactaatcctagcagagcaggggcccaccctgagaacctcacttaaccataactatttccttagaggctccatttccaaatacagccaccctgagggtcggggcttccacatctgaatttgggggagcacaaacattcagcctgtgacaaggataccaacagatgtcagccaccacagccaggccttgtgacccaacaggaggctgcggtgtccctgggcatcgctggggcatgtctcaaatgggtctaaacccagtctctctggctgagagcagaggtctgagaggctcaatggcaggaaggagcccagttcagtggggaggcagagagcacgcagcctccctccttggcggggttcggatgctggccagccttcagggctggccggctgctgcccaaggcctcccgcttctccaggaagggccctcccttgctctctccctctctgcactcaccccttctccctctccctacacgcttttccactgtgagactggaacatcatcgggacagcccagaatgtcctcttcccctgcaggagctcagcaaacatccacagagtgaacattccaagcaacatagtccaggagccacgttccagccatggggcctctgcactgctgttctcttcacatggcctgcccttcccccagaaagagagaagaggccctctctggttgtcccatcaaaactccacccttctctcaccctcctcccagctgtatcccttctctgcagccctaacatgcattccactttatttcccttgtctactgtctgcctctctaactactaagtcagttccagccgctccaggatttttgtcttttcagtttagccctggttcctcagggccttagtgactagtgtgtagtgcctagcagccagtagatgctcaataactgcttgctgattgactggggtgagctccccatccatggagctatttcaagccaagcctagacgatctttcagggctagttctaacctaagacttggtagttccatgactctcttcctggcccagaccgaaaaggaactttcagcaggaacccgggactgggatctgagatggggctccttggaggactctgactaggaagagagacgggaggccgcaccaaaaacacaagcccttcatgggtctcccaggcgtaggtctggggaatcccccaggcccctcaggatcgaccctgctggccctggatctccaggacgcgtccctctgacctgcctgcccggcctgtgagtccccggcagcaaccgctgcagacacaggctgcccagcgccagggccaggccggattatcatacattaagacataattactctgcggaaatttacaatacaaagcgccctccccaagttggcttcagaaggattccaaggatacaaagacctgctgtgtctgccaccgacccaagctggccccagccagaatttcaaaagaagtgggtgggttagtttttggaaaaaccccattctaccctccaggcagaagccccgccccaagggtagagccctctgataccccaagccccacccagaggggagggtcccctccaccccgaccagcgttgctcctaaaccactcgggttcccccaagcccagaagctccaagctgacaccaccaaggtcaccccacttctcccaagttctctctttttagactatttaggcctaagggcagaaagaaccttaaatcccaagatgctagcttttgacctgcagagaggtgtggcagcccactgacattgattaagcgcctgctgtgtgcctggtactgtgccagcatcaggatgccacagagaacaagacaaaccagatcgctgtgctggggggagcttacagtccagttgaggagacgcagtaagatgctaaaaaaaaaaaaaatgcacatcaggtgtgcaggatgggtgagtgaccggggtgcacggtggccagagagcctcaaaggtggcatctgagcagaggcctgaatgagcaagagagactagcctgtgcaaaggccctgaggtggggccatgtgtggtgaggggtagtggaggcagagaatgctggcttttactctcaagagggtttccagcagggaagctgcctgattcgggggacacttggcctgctgttctgttagattcctgcatctaccacctcctggccctgggatgctgggcaagtcagttagccctttaagcttttgttcctccctgcaaaataaaaacagtaaccacagctaacacacgcttgttgcacagaacaagacagagaaagtcgggaaagggagggccatgcatgtgaggggcgggggagaagctctctgagccttagctgcccca

SEQ ID NO: 6097 - DNA, 2296 bp, Homo sapiens
tgtcagagagcggccccttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagagacctgcgtgctctgaggctgcccgaccctgagctccagaacagaccatcgagttcaggagacaagcatgtcagccatgacacaaggcagatgagagggacccccagcgtccacacgtggaggcagcgggggcagccgtgacttccttctgcagtgttgattcagctccctttgaagatccatacaaacaggctgaccatcagggctggtcccaggccaccaggctgggtgcaatgcagaaatggagatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacttctttggggatgtgtctccaagaaaagtgtgggctgccttcctcaccctggatgcctgtgggcagccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccttgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgcgactactcagctctgccattgtggctgcagagtgaccatagaccttctgaaagtgaatgagtatgactgtgttccaataaaactttattgacaaaaaca

SEQ ID NO: 6098 - DNA, 1197 bp, Homo sapiens
gtgttggggacttgagatgcgtacatgagtgtgatgtttcctgctgaaagcacaggtgagacgtggtcttgtaacacagtggttaagaatgtgactttggagccagcctgctaggggctgaattctgactcagccatttactaactgtgtgaccttaggtcacagaattttccacactccttgacagaggtgcttaacccttatccatcagcattctcagacagcacctccggttagggacagtatctgaccgtccgacatccctgcagcccccatgtgtcacacagactcagcctcaggtagatggtttccgtagatggtggctttctttggacccttgacatcaaccagttactatttgggccacacataacaaatagaagcagagcaagccctggaactcctgcctgacagtgacacgacgacagaaacatcttaccagtcagaggaccatgagaaatagattcaaggagcattccacgtgcaagtgagtcttggccccatctgcctttggattttagccgtgaactggaaggtattggaaagaagaccctcagaaatagcttaatcaaaatccctgcgtctgaaccaagtgccttatttctctgtgggcctcaagcttcgctgacatctgtggagcacactgtcctaacaggagtgctgtctgatttcccaacgctctgcaaaacaaacagcctggaagggtggctggtggaaggtggtttttagagagagacttgtagataacaggaaagtgaaggctgtaaggaaggttgtaattaaacagcacatggaaacacaatcacattattgtcccattccatagggataatgatgaccacttcagtgggaaaaggagaggttttaagtcattagggactatgggccaccttttaggaagatttattttcaaaggttaaaatagtgttttggcaattcaagtttcattttcagaaaatgtaattgatgggaacctcagtgactctggatgaataagatgctgttgagtggctctgacttgggccagccgtgcttctcacaggaccttggagaccaaggtcactgtgatctcaggttcagggggcaagtcctctccacacagccctagttggcctcacagctgaaaatgtctcccttactgttggactcctttgttcacccacatgagtttgtgaataaatcctttccagtctgaaa

SEQ ID NO: 6099 - DNA, 689 bp, Homo sapiens
aggaaatttctggtgggccttcgcggctccgctgggttggcagccgcttgagccactgcgaggaaagcaaagtctgggccatggagatgagcctagtcctgctgttcctgatccgcactgccctttttgcaccccagggagctgctgctgatggtgccaagaacgaagaaggaagctcctgcccctcctaaagccgaagccaaagcgaaggctttgcaaggccaagaaggcagtgttgaaagatgtccacagccacaaaaaaaacaagatccacatgtcacccaccttccggcggcccaagacactgtgactccggaggcagcccaaatatccttggaagagcacccccaggagaaataagcttgaccaccatgttatcatcaagtttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctagttccaaatatatgtatatcttttcaccattaaaagaatcttaatctctc

SEQ ID NO: 6100 - DNA, 2386 bp, Homo sapiens
cgggggggaggggcggcgaggcgaggcctgcggagcggaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacagatggagtcttgctgtgtcaccaggatggagtgcagtggcgcaatctcggctcactgcaacctctgcttcccgggttcaagtgattctcctgcctcagcaacccgagtagctggcactacaggaaaacaagctcagggctcccactgattgtacattatggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtcacagaattttccacactccttgacagaggtgcttaacccttatccatcagcattctcagacagcacctccggttagggacagtatctgaccgtccgacatccctgcagcccccatgtgtcacacagactcagcctcaggtagatggtttccgtagatggtggctttctttggacccttgacatcaaccagttactatttgactcttctgcagaaccccatgttgacccctgctttgaggtggcagagttaacactactcttcgttataagctctcgtctggggcaactcagaagaacccagagacagactcccagactcggccagaggctgatgccaactccttccagctctcacggtaaccatgaggcccctgcgtgtttctgttgtggaggtcccagagggaactgtatggacagacacagcccgaagggccatctgcctcaagccacagcagcacagaattctaaagattgtggggaaggatggggccaaggggaccagatgtgcagaggtaatgaataccagggaatcaggaaaccactggatcagttctttgagccacagaacaacactcatcccagcagctgggaagctatctgcaaaagtccatctgcagaaagggcttcctggtcttgcgtgtggctgggccatttctctggatgcaggtttttcattatacagtcttctcaaagaaccacctgctctcaacaccttctcggtgactccatttcccctcctctgggctcctggaatgccacaatggccccaccttagccaggcagctgtgatgagaggtgttgacccaactgcctctctgctggctcactgaatcaggtggaaggggctggggacagcacagtcttgcattgtggttggggacctgggccatccagaggcaggactgtccaaaggcagggtactgctgggattccgccaggcactgggtgatgcatggcatagggagctgaagagggacaggctcttggccaggaaaaacagccccagagccacaggtgtgccatcgagtcttcctcctctcccatccttaatcactcctgtttggtgacagcacacagctaggcctggagcccagcaaagagcccctgggtcccagaggaagttgttctgggggctggagacaatcacaaatgccaggtttgtgagccccagactctggttcatagcaagaggcagacttgtgaacaaaccaccagatcacaccgtaaaacacgctcaacgaggagtgggtgccctttctagggacaggcagaaggctccatggagtgacctttgaatggggacataaaagtggatcccttcaacagcccctgcacagccccaagtcaggcctccagcccttggactcacagatgtcctctgtagacgactggatgtcctcccgtgctaccctttacccctgcagcgaggggcacagagccagagccctccaggtcctcaccactggcatcaccaacatagtggacattttccctctcagaatgaaaagggagtgaaatttcccgtgatctttccacaaatgaccagcttggggagtgggagaggaagtgctgcagtgcctggggaaggggccctggaacagttcctggaaatggagaggggtggatagggtggagacaatgctcatggagtgcagtatggggcctacccagagttgcttggccacccctctgcctctgaatcaggggtgatcaatgaaggaaaattactgca

SEQ ID NO: 6101 - DNA, 1221 bp, Homo sapiens
aacaagacaaagaaagctttactaagtgttagaacagctcagaggaaacccttagtgcatagctcctctctgtaggcagatcatcttctctgtaagcagatcttcccattgagtgctcagctctcaagcagagaggaggccctggagagggtagctcctctctgctattggtcatcatcctgacatctgctgctctcaccagaaaggaggccctcgagaaagttacttctctctgcagctggtagtccctatgtctctgcaggtctctgaagctctcagaagagagagtagttcctcactgcagcaggccatctgtcctctgtcatctgtcctctgccctgctctggctgagcctggggcttttttggaccttagagggaagaagtccctgttgatcagttcatggagggccatgggcagtccagaaaaggcaccacaagtccccactccattctgctggtctggcagcctggctcccagccttcaggccctccttggcctgaaggtggggtcttactggcaacccacccacttccacccaggagcctgcctgccttctgctgtccctgtccccctggctgctggcaccaagaggcacctgcaggccagcactgagcaatcctcagagctcccctctgcttcccctcctactctcattggtacccaaattctggagggggctggggcagcagggcactggcttgccagcactgatccaagtgtgtgcagaccatgccaaactgtgatagcacccggccttggctccaaccctgctctgatatgggagcctgtgcccggagcagtgagaagccaggcaactggagaagacacccctgggcttatgggtaccggggtcggggggccttccctggcccctaagggtgtaggttgcagagacacctaggtcttgtacctgggaaggtggctgcagctgcacccagggagctcccaccctgccaactcagaaggggtggggttcctgcttgtccttggctcctgccggcttggtggagcagaggcccaggtctgcacttgtggatctggtggttgcacctgcaccagggagggcagagatcctccctgctcctggcacctgcaagagcacagggaggctctgatcggcagccacagcttgagcagctgcagccttactcaggaaggcaggactcctccctgctccatggagcaggaggcctgggtctgcagctgcagctgcaccca

SEQ ID NO: 6102 - DNA, 541 bp, Homo sapiens
ataggcagccagagctccaaggctcctcggaagacgtgaccaccaaggttgcggcaggtgcttcccctgcaaaggccaacggacaagacgatggccacgtgaaaagcaatgaagacttatctcccaagggtgaaggagtgttgcctctgtgaacagaacacatgaggcagccggggccactggcgatgccattgagccagcatcccctatccagggtgctgaggccaagggggcagtctcccctaataagttctctctcaagaagtctttcaaattcagcaggctgctcttccacaaaaattggaaggaggacgggggcagttcttctgcctctcagccagaggaaatgcaggagcaaggtgcctgtagcaacaagggcactgcccaggaaaggaaggctgctgctacccctgagagccaggagccccaagccaagggggcagagggtaatgctgcctcagaagaagccccaggctacagagacatccactcccttggggcagagagtggccctataccaggcagtgctgagcagaatgag

SEQ ID NO: 6103 - DNA, 1361 bp, Homo sapiens
gctcacatcctgggctcaaagccctagtgacacagattattcagttggggcactgatgtccggtctgacttccctccaggccccagggtctatgctaaaccaggcagtgagattgtaatactccaatgatcactgctaaagacacattagggaaaagaacagagaagaaatcaaaagatcccttcctgatttcagggaggaggagacagacaggcgtttggggtttgtcgaacgggagacggagggagtgggtacagacttcaacctattccctcattatgtttacattcaacacaaaccactagcggggctgggaagcaaacataatcaacaacttttcggattttaaactcatcaccttggtgctcattacgaagggtgcattgactgcaccctcaatgaacagactaggctgtctctactgtgggtgcttataggagcaccatgggaggcagagggaagacagaaaagccattttggggactcaccaggtatagggaatcactttggaacaagggacccccccatcagatccaaaagagagccacgttccaaaattctttccagctgagtccacccctccctggaagcccaccctagccccttctagaggccaaggccaccgccttatggagcatgagcatcccttgctgcagccaactatgctagactccacagatgctgaccacggtgggcttcatgttgtattgggcctgcgttaacccagctctctctcgagacagagcgggtgggggagctgcagcagagggcagacacgccatcagcacccccccgccaacagcaccttcctggtatttataaacacagagatcacacgcacaatccctccagtgcaaaccagtccggctgctttagaaacaagttgttttctgcttccagaaccacccaggagcctgcgtgatgtctcttcccccacccgaccccctcttccctctgccggtctccttgctccaggtacccccagaccctcaaggtgctccttcgttcctggggggcagtgcagcctcctgtccgtgatccttacagaagacgggtcggcgggggggcaggcaggcaggcagggggcacacaggcggcatgagccaaccaaggctggcttcttccttcctgaccttcgcacctgattcccagagcggcagccctcgccctcgctccagattacttgaaggagtccaaccatgtttctgggtccccaacccctttcagaaaggagttatgactgatggagaacggggaggagagagagagggctttcctgaaggaatagggtcccaggatgtcgagaggtgccagtgggtgcaaagattttcttgtctgtccaccacccagagagaagacgc

SEQ ID NO: 6104 - DNA, 743 bp, Homo sapiens
gacagggtcaggacagctggaagtgtgaaatgaatgcagccctgcatagctgtcaaaggatcaagctgtctgcagcggccgactgaccatgcacacacacactcggcagcacccggctaggcattacctacttcaccaccgatgtagaagtcagtgtttgtcgggtgaacgacagcatcactgtcgatcgaggcaatgtcagcctgtacaacttgcaactataacagatgcttctggtgttatattcagaaatgtttcattggaaaagaagctattttggcgggctctgcttcagctagccaggaagaccccctcagtggcctgtatctgactctcttcgcgggagaaccacctgctctgtctaggggaatgggattctctgggggaaacttggatttgctgaaggaagggagcagttgcgaacagaactcaagctcatggagaattctcagcttcctttggactcactaccttcccttctgaccagaggcatccccactcttggaagtgcagactacagtacctcagggagccactactactcagcattgaggatttcctgccaaccaagtgctgtttcactcttcacatctgtggatgaggctagagctgtgattttccaactatgctctgctatgcactggggctcagcagaagtcctcagggtatgcagctgagccacaaaagtttttttgctgtaaaatgtgtacaaatatgtatttttaaacaatcttgactagaaa

SEQ ID NO: 6105 - DNA, 391 bp, Homo sapiens
ggcagctccccactttcccgatggaggaaaggagccgaggaagatcatccagtcactcgatggggattaccagcggaccacctgtttgtatcaccttcccacctctctgtagcaagaaaaatcacttcagcacctcttcagtaataatgatgaaactggtattaactgaatggcaattatggatttttaactctaattcacagtaaaccagcaagccatatgtttaaaatccaaccaaaaatcgttctgtgttgctgcatgtctcataccgttgtgagaagttgtgagatagccacttgtgcaaagaggaatgtaagtgttacctgcccgaggaacacagcagaagcagaaagagaagacgtcttaatttatcattacagatatatgaaag

SEQ ID NO: 6106 - DNA, 457 bp, Homo sapiens
ggtgagagaagcagaggcccaaaggaatattgcaaatacccaaggtcaccctgtcaggagtggcagaatagggctggaacaaggactcttttctctggacagcttgcacctacaatcctttccatcttgcacctacaatccactcgaacactgcagcatggaggcagactccttgccaacgggtattgtcgagagcttcttcctaccatcatttgaagaaaaaaagcttggagatggggaagaatgattgatcaacatgtttcttccttagtttgttactgctgttgttttaaatcgagaaagcatttttaaacaggatggggggggactgataatatcagtcctccttaatttcattacagccgagtcatcagtattttagtatttcttgcaggttgatgattacaacaatataattttatttattttaattaaactctatttgcttcccacataa

SEQ ID NO: 6107 - DNA, 322 bp, Homo sapiens
cgcacatgagaacatgcctctcacaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacgggaggaaaagcaaggcttacagaaggatgttccttcaggaggaagcagcactaaaagcactctgagtcaagatgagtgggaaaccatctcaataaacacattttggat

SEQ ID NO: 6108 - DNA, 527 bp, Homo sapiens
cactggggacccctcccatgctctgggcctcccatgctccaggcctcccatgctaggcacacggcccaggggtgcaggaggcagagcccactctgaatggttgtcactgctcccctccccaactctacatccgctgcccaactctgctgggtccacaccaggcacagggcccgcacagaggctgcgtcccatcactaccaccagtgtgttgggacaggaagcccagtgcccatagagcgtcgagggaacctaagctcagaaagtctcctacggaaggcagcacacagacagacaccggtcagagtgggaagctggttgctaaggggtatggtggtggggcctgcctggctcctgaggatgaaggggcgtccgtggccaggcagcagtgagaactccaccctggggagccacagagggcgctacgcagcagagaagcacagttctcagaggcccgggaggtggggaggagagggctccagggcccagggcctgggatccagccccgtcccaacctcctgttgggagcc

SEQ ID NO: 6109 - DNA, 1685 bp, Homo sapiens
gccgccgccgccgccgggcacccagccccaggggggcgggctggagggagggggcgggcgctggccgggggacccccgcaaccatggcgggcggggagtgggctgccgagccgcttcacctgccgcagagggggcggccggcgccgcttcacctgccggagcgggaggccaccgaggcgaggccgaggcggcggcgcgctcggcggcgcctccgggtcctagaaccgcatcctcccgctcgcctcgggcgagggattggccgggtctgggtgaaggggatcacggcctggggattggaggggcacatcttctccgcaccgaggatctcagcgactgcgagcacggctcggagacccacggtggtgcagcgttggggcgccagggctgcgttcccgtctcgcgtcccggactgagaagaaatactttcagagctctttcattcatcctgacaatggccagagaagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaaggaggtatctttcccatcttggcccacagaggaggaaatcctagaagggatgactgaagcttgggactaacacattggtggatctgtgctaccccctgctggccgtagacggtatgacagccaagatagggcaaggcttcgaggggcgatggatggattcaccgcagcggcgacatttctggactgttgtcaccttcagtgcagtcactgggaatattcagaacccaggtgattgataaggttttcccagggatctcttctctccccttcaccattactcagtaggagcttccttaaaaacggaaaacgagaggccgggcgcggtggctcacgcctgtaatcccaaagtgctgggattacaggtgtgagccactgcacccaacccaacgctatcctttctatgtaactcactagaggacagccccagggagtggaccagcaaagaccgcatgagccataccccagtgacacaggctcccaaacccggccatgtatcacaatcagaatctggggggagtacggtcagggatctgtgtcttttaaagtcctccaggtaattcagtcagttactgacctgtccttgtcaatgcttcccagtgaagagagtacaggctacatgtcccaggtacatatcccttccctttagacagcagtcatcactgacgtcttctgagtaccagtgctgtgccagacactgaggcattctacgtgttactgtaaggcaaacagcatcccggcagggcaggcctcgccaatgtgctcactgagctcggtgtcctctggagtgactgacttattcaatgtcatattgctggtaaatgtcagaactaggatctgaatgcagtcataaactccctgagcctctgttttcttctctgaaaaaaaaaaaaaatggtgacatgattttattgaattgttttgaatgttcaatacaattttatgtaaagcacttagcagagacttttatttccagcaataaggtggactatatatgttcagaaaaactcttgtgtacaaaacagctagaaatgctag

SEQ ID NO: 6110 - DNA, 819 bp, Homo sapiens
ctttttccagagaagagaagctttactggtgttccagccctaagtctcgctctgtcgctcaggctggagtgcaatggcgcgatctcggctcactgcaagctccgcctcctgggttcactccattctcctgcctcagcctccggagtagctgggactacaggcacccgccaccgcgcccagctaattttttttttttttagtagagacgcggtttcaccgtgttagccaggatggtctcgatctcctgacctcgtgatccgctcgtctcggcttcccaaagtgctgagattacaggcttgcaggcgtgagccaccgcgcccggccgagttaaagtactttttctggaacaaagaaacttagcataaatagttaaaatattaagagttgtaattaagggaaatttcagctcaatatgacttcaacagtttaaaaaatgtattatttcacataagaccatggagagaggaattggaagccccagaattgattgggtcagaaattgaaaatgatactatcagtgacccaggtttgaatgtctctctccacagcattgacttcactaatggatgtgacctggttggcagcagtagcttgcacaacatgcttgtttgcagtgagtagtagagagaaggttttgctttcccagaaactctgaaaaaggtcatcaaacctaaatttccttagccttcttcttccatgagcaaatcactagcagatgattgctagcaaggtgttactattacaatgaacccctaagtgtcagagaaagagttagtttggggaaatatcctctccaccacaatcttagtcattgaagtc

SEQ ID NO: 6111 - DNA, 713 bp, Homo sapiens
gtgcttcttagcagccttctggaagagatctcgcaggtctgcttttgtgtgggacccctccatcatggcctgcacaaaggctgtggactcgctggtacaggaacgcacagtctcagtccgtccctcccggaacattctggtcattgaggcctcataggtcaggcagaacttacccctgtcccggaagtgagccagctgcagcgcgatctgcacaaaggcatcagggctggtccggcacttcttgatgaggcctttgccaaagggcaggaactggaagcagtacaactccacgtcgtctgccaacgccttggccacctggtaggaactctcgatgaccgcctggcactgttttggaatgtcccactgcagccgtgtaggaggtgcgagcgcagggttcggtttgcccaggcagtgcccggtctccgtgtagcccaggtggaagctgtctgtgcccaggacaaactcccagaggtgcccaatgatgggagcatctgcccacgcatgctctgcattgagacccaactggccattcttgaaggaaatgagagtgaaggatttgtcaaaccacctgcaggaagagtagacacatgaagaaccaaagctgggaatgtccagaggtgcctgacctgcaaccccaacctttaaccctaattactaaccctattctctctctctttttctctcactttttttttaaattgagatggaatctt

SEQ ID NO: 6112 - DNA, 5932 bp, Homo sapiens
cgccgccattttgggctgggaggaggcagcggagggactcgctgcgcagtgagagcaccccgtggggggtggtccgggcgcggggagaggccgggccgagtgggctacctgaagtggcggcgccgggagacggcgggaagtgggaccgggggccagggagggtgaaggttggagtctcctcggccgagcccggtcctcaaaccgtcccggcagccccgcagcctcgcctctcacagagtgcggggttcttcggtaattaccgcgtgtttcccgagaccccagaaggggagaggctggtgaaacggcttccctctgcggtctttccacaggggcgcggatcctgaggccgagctctgccagcttccctccccacccccattcggcctgggtatggcggcgaggccccgcacagagggactcccacttcgactggagaggtgggggcgacgccagattccagaggctggcgccgcgggggagggcggaggtcgcaggtctggccacaagtcggcgtggcagtcagctggaggctccgagagcggagatcccagtgcacccaccttacctcgcttacaccaaagcgccatctcgccgcccgggttgcgaaaaaccacgaccctcttaaactactgtagcaaccactaattccccctgggagcagctagagaggggcacttggaaaccttcacgagctcggtgcctgaaggtctctgaggctcttgccctcaagatctctcccattcagccccgattctccggacaacctgacctagcatgtcgccagcctcttggtgaaacgcctaaagtgtgctgccccacttctcttgaaagtttacaccgaagggatgaggttttgccctttacagggttggggcacaaagtcggagtcgctgcggctccgaaatagaaacggagttgcccatttcgtatgcttcatcaacatctgcttgcattttgaaatcctagtcttaacttttacacaacttttagagaaatggctgccctcctagagggaaaaacgaactacagtaattccaattccaatgtaatctttgtaagactacaaaatctttccagtttaaagatttttcttttcccacagactaaacaaagtcagagtattttgtgttctactggtgcattgttactaggtaacctcaattttttgaaattccaagtaattgaaggatcacttttgtagatcctaaatgctaccaaaaaagaaaccagtttttatctacttcatatgtatagcgtttaagagatgaggagacctgctttgaaagaataaactcttaaccttacattatagctgtagcagcttcttaaagattgaagtttgatgtgaagttcttttattgaattgcaggttaaaccatcttacttcctactgcttgaaatctaaatccagagagatttgtggctcaaggatatcttcaaataaaagttttattgctaaaatgtcagttaaaattatgcctaggtaggtgctgaagtaggagaggctttgacgtagcagagtgactggcagtgaattttgtgggtaccttgtgatgagtcttattatcagttacaaatggtcaaaacatgcctaagccttcagccttactaaaagtttaacagaacttggcctggcgcggtggctcacacctgtaatcccagccctttgggaggtggaggcgggtggatcacctgaggtcaggagtttgagaccaacctggccaacatggtgaagccccttctctactaaaaatacaaaattagccgggtgtggagttgcgtgcctgtaatcccagctactcgggaggctgaggcaggagaatcgcttgaacccaggaggcagagtttgccatgagcctctcaccgttgcactccagcctgggtgacagagtaagactctgtctcaaaaaaaaaaaaaagttttccagaactgaagttctgctcctcctattaataatttttcttcagttggagtgacaactccatagcattaacttttttccctctgctccccagatgttttacaactggattacaaaataggatcatcattgactagggtcctcaatccaaaactggaaccacttactcctaactgaagcttcagtacacttgatgcctactgtggtttgattttttacctacatatgacatgttcgctctacactgatcaagagatgtgagtttaaaaaagctaactaacttggtaggacttaaatagtcataggaacagaaaaggcttttaaagacgatctttgtgggtcttctgtcaagaatttaatggaggatcctagacacttgggattcatcctccattatgaagtaatctagtgaaatttttggatgctactgagtggcaaatactgtaccagcagcagaaatttgttactcatttgtaaatgaaacttactatccttaaggttgacccacaagcttttccattctttgctaagaaaaattgggaataggccgggcacagtggctcacgcctgtaatcccagcactttgggaggccaaggcgggcagatcacgaggtcaagagattgagaccgtcctggcagacatggtgaaaccccatctctactaaaaatacaaaaattagctgagtgtggtggtgtgcacctgtagtcacagctacttgggaagctgaggcaggagaattgcttgaaccccggggctggaggttgcagtgagccgagatcgtgccactgcactccagcctgggtgacagagcaagattctgtctcaaaaaaaaaaaaagaaaaaatgggaataaaaccagcttattagtggcctcctggttatctaaggaaaacacaggactgtaggactgaaaattaggaactccgagctctgtttctgtgtgtgctgcccttaacttggttgacttggccagaggccaaatactgataatgaggccaaactggtcattttgctgcttagtctattgttcatctactgttcaaccagactttcaacttccttttcagctctcccctctcagatgagttgcattatgcttttatgacaaattctacaaactctatattcatttgaaaatggtatcagcactgtctccctcataaatacctagaggagtaactagtcttaagtcgctatgtaaacacttactccttgtaactttgttatatgagaacttcacaaggaatgcttcaaagatcattggggcagttggaaagcctgccttaccaaagtgtggccttagttgtccatagcatcacaaaagagccatccaagtaggctgaatgaggatcagtctctcagggtgcccactggttgtggctgtgaagtcctggacactcattttgcctgatggccaaatcctagggagcagtgactatgtgtgagtaggattcgttgacagaggtaggaggttttttttttgtttttttttcctgctgcctgtataattgcagaaaaggagtgattctttacagtaattccccctcttcgggatgaagatgcttgcttctgtttggtttccacagttaaatcaattttttttccttttcttttgagatggaatcttgctctgtcgcccaggctggagtgcagtggcgcgatttcgcccactgcaacctccacctcccaggtttaagcgattctcctgcctcagcctcccgcgtagctaggattacaggcactcaccaccatgcctggctaatttttgcattttatttttttctggaacggagtttcacctggttgccaaggctggagcgcgatggtgtgatcttggctcaccacaacctctgcctcctgggttcaagcgattctcctgcctcagcctcccaaggagctgggactataggcatgcgccaccatgcacggctagttttgtatttttagtagagatggggtttctccatgttggtcaggctggtcttgaactcccaacctcaggtgatcctcccaccttggcctcccaaagtgctgggattacagtcagtgagccactgtgcccggcctgtatttgtatttttagtagagacagggttttaccatgttggccaggctggtctccaactcctgacctcaggtggtccgcccacctcggcctcccagtgtgctaggattgcaggcgtgagctacggtgcctggccagttaatcagttttttaccctcctgtgtttaggccccaacatcctgttcttgatcttttttggcaaaaatttggccaaagattgaaattttgcctcctggaccatatattttgctccagttgcaaagtatgacttttatcctttggtcagcagttcccatggtgtttagggcctgaatttgacattcttttttttttttctttttgagatggagtctagctctgttgcccaggctggagtgcagtggcacgatctcggcttgccgcaacctctgcctcccggcttcaagcagttctccctgcctcagcctcccaaatatctgggattacaggcgcccaccaccacacccggctaatttttgtagctttttttgtttgtttgtttgtttttgagagtctcactctgtcaccagactggagtgcagtggcgcagtctcggctcactgcaacctctgcctcctgggttcaagcaattctcctgcctcagcttcccaagtagctgggactacgggtgggcaccaccatgcctagctaattttttttctgtatttttagtagagacggagttttaccatattggccaggatggtctcgatctcttgaccttgtgatgcgcccgcctcggcctcccaaagtgctgggattacaggcgtgagccaccgtacctggcaacattctctttttttaaaaaaataactttttatttctagcctcaaccatttacactttgcttgagaaagaataataaagtggaattgttattccagtgatgttgtgcaaatgtgagaaatagtacttcccccaaaaaaacaaacctcgaaaccccacaaactcaagtgtacttaagtacttaacgttcaagtactttttaactataaccaacttttccaccacactgttgtgaatatttgttgctagctgttatgggtataagtgatcaagggaagaactgatgcattacctaatgcttgactaaatatagccagcccttaagtaggtagagtatttggttgtgggttttgttgtttaagtctgtggagtccctctttggtttctttaacttttgcagtcattagggcagagtatatttatttacatttctccaagcaaagtcttgctctgttgcccaggctggagtacggtggcgcgatctcggctcactacaacctctgcctcccaggttcaagcaattgtcctgcctcagcctcccgagtagctgggattacagatacccgccacgatgcctggctaatttttgtatttttaatagagacgagattttgccatgttggccaggctggtttcgaacttttgacctcaagtgatccatctgccttggcctcccaacgtgctgggattacaggcgtgagccaccatgcctggcctaaatttactttttaatagagacgaggctggttatgttgcctgtgttggtaactgtgttgcctaggctggtgtcaagtgcttgagctcaagtgaccctcctgccttggcttcccaaagtgttaggattacaggcatgaagccactgcgcctggcctgtctaatctttattatgcttcccctctttagagatacttagtctgtttttcagaactaaaccaatctggaactccctggctctctctcctaaaactctgaagtctagaggaccctgtctcctgagggctctaagaaaagctgtccagctagctgtgtcagtttgagaagcagtttttcctgattgaatacctaggccccagtaggaaaaagggaacaaactgaaattgctaatttgtaagcctggtcttttgagcagctcagttaaaa

SEQ ID NO: 6113 - DNA, 959 bp, Homo sapiens
agtgctccaaaatactcggcctgggggaggctggtccgtgagcgtgcgcccggaccgttccgccatgcatagtggacccagcactacagcaagcctggcacgacctctaaggcggttcgcggcaacgtccgcacgtcggctcgttggtctaggggtatgattctcgcttcgggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctcttttggttttttttttttttttttttgagacagtctcactctgttgcccaggctagagtgcagtgtgcagtggtgggatcatggctca

SEQ ID NO: 6114 - DNA, 278 bp, Homo sapiens
aggtcgatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatgatctcaagttttcaatctgagacct

SEQ ID NO: 6115 - DNA, 633 bp, Homo sapiens
tttatttaatattttttatttaatcttttaatttttaaaaaaaacccattaacagtacattttggtctaaaatggtccctctgctgaaatgctaggtgctagccgtaattctggctttaaaaccaaaaccccaaatatttaataaataaaaattagaattagttgccattctactccaaaccagctagcctagctgaagagaagagggaagggggaagaggccagagaaaggaggaggcagtcagatcttagacctgtcgctacagggacagctgaaagaagtagcactaagaaagatcatccgagcagtccccagtacagcccccactttttggcagaggtagggtaagggttatgtgcaccctcctcctaccctcaattcatttgtgtcatagagggagaaagttaaaagctcagctttggtttctggcccaagttagggagcttagaaaggttagccttggtccagctttggcagaatgaggcccacagatgggacaataaggcagctggagtaatggttcagtcattcttacgatggttgttattgaggatggggtggccattggctaggggccggctctttgctcctcccccagctgcagcctcctccccctctgagctctctgtttc

SEQ ID NO: 6116 - DNA, 2715 bp, Homo sapiens
aggcttctggtctccagcggcggggaactcacacctgccgctgtgaaaatgcagacccgcggggcagtaattccgagtccagcctggggcgcgatctggaatcttgactcgcttgaaacaccacgacggattcggagacaggtgagtagagaaatgagcctcagcccctcccacgggccgcccacggattccaggatccggaaactcttcctgctgctgcgtcaccccaggaaggcagcgcccgcctctgggcagttctgatggaaactggcttcgccgcccagaggaaaacccacaactaaggggccaagaaaaagcctccatggtcccgccctttcagtgaggatcctaatttataccccgagtgtggcccccatcaaagtctgcagtgacagccgagcgcggtggctcacgtctgtaatcccggcactttgggagaccatggcgggcggatcacttgaggtcaggagttcgagaccagcttggccaacatggtgaagccccttctctactagaaatacaaaaattagccgggtgtggtcgtaggcgcctgtagtcccagctactcggaggctgaggcagaaaaatggcttgaacgcgggaggcggagcttgcagggagccgagatcgcgccactgcactccagcctgggcgacagagactccatctcacacacacacaaaaaatgtagagtgacgttcactgaaatgatactagaccagcgggagggacccagagcgctgcggttcacagaatgcggtgacagcgccgcctcgcgtcctttacttcaactgccccaggcagacgtggtcacgtgtgttggcctggaggctggaatacaccggggtcaaatgcagagtggagaaaggagggaaggatgggaggacgtgttgaagaaagacagtaagagctagcgctatggttcatatctgtaaaactagagttttcggaggcgaggcaggaggatcgtgtgagaccaggagtttgaggtcgcagtgagccgtgatcacaccactgcactccagcctggacgacagagtgagaccctgcttttatatacttttcatattttctgtaattaagcaagttttgtgtccggaattggtgggttcttgatctcactgacttcaagaatgaaactgtggaccctcgcggtgagtgttacagctcttaaggtggcgcgtctggagtttgttccttctgatgttcggacgtgtccggagttttttccttctggtgggttcgtggtctcgctggctcaggagtgaagctacagagctttgcggtcagtgttatagctcttaaggcggcacgtctggagttgtttgtttctcccggtgggcttttggtcttgctggcttcaggagtgaagctgtagaccttcacagtgagtgttacagctcataaaagcactatggacccaaagagtgagcagtagcaagatttattgcagagcaaaagaacaaagctttagcagtgtggaagagaacccgactgggttgccactgctggctcgggcagcctgcttttattctcttatctggccccacccacatcctgctgattggtagagccgagtggtctgttttgacagggtgctgattggtgcgtttgcaatccctgagctagacacaaaggttctccaagtccccatcagattagttagatacacagtatggacacaaaggttctccaaggccccaccagagcagctagatacagagtgtagattggtgcattcacaaaccttgagctaaacacagggtgctgattggtgtgtttacaaaccttgagctagatacagagtgccgattggtgtatttacaatccctgagctagacataaaggttctccaaggccccaccagagcagctagatagagtgtggattggtgcactcacaaaccctgagctaggcacaaggtgctgattggtgtgtttacaatccctgagctagacataaagactctccacgtccccaccagactcaggagcccagctggcttcacttagtggatcccgcaccggggctgcaggtggagctgcctaccagtcccgcacggtgcgcttgcattcctcagcccttgggtggtcgatgggactgggcgccgtggagcagggggtggtgctcgtcgaggaggctcgggccgcacaggagcccttggagtgggtgggaggcttaggcatggcgggctgcaggtccccagccctgccccgcgggaaggcagctaaggctcggtgagaaatcgagcgcagcgctggtgggctggcactgctgggggacccagtacaccctccgcagctgctggcccgggtgctaagtccctcattgccaggggccagcagggctggccggctgctccgagtgcggggcccgccaagcccacgcccacccggaactccagctggccggcaagcgcggcacacagccccggttcccgctcgcgcctctccctccacacctccccgcaagctgaaggagagggctccggccttggccagcccagaaaggggctcccacagtgcagcggtgggctgaagggctcctcaagtgccgccaaagtaggagcccaggcagaggaggcggggagagcaagcgagggctgtgaggactgccagcacgctgtcacctctcggttttactttattttaggataaaatatctattgtgaattttaaaaacatgtaaaataaaattttaattaaaaagcctaaa

SEQ ID NO: 6117 - DNA, 3698 bp, Homo sapiens
acgtcacttccggaagcgactcgctctgacgccgtccgccctcgttgccatggagacgcttgcgctttcccgggccgcacttcccacccgggtcttcagaagcccgtggccgctgggtgagcccctgcgtgaacgcacacgcacgcacacggcttcaggttgccccgcggcgccgcgcgcgatatcggctcggatcccgggaggccgtccgcccctttttcagcggatagctgaggccagatcacacctggctgtaggcccaaagcgaacctatcactggcacagaagcttggacctggaaggggactcatggaggagtccgctgtcttttagagatgggaaaactgggcccaaataaccaagtcactggtttcttaggctttcaggcaggaggtctgagagtctgtcttaaagagaccctctgtctggggcccagagcacccctccttcctcaatacacggccacatccaagataatcaaggttagtctcatgggtgacagaaaaataaccatggcagtgaatatactgctgggtcctggttttgctgttaccattcttcaaacagcaggactgggaaaatcccgcctgtcccctgcctgctctgcacgtcattttaacttcatgactgaaaacagcagccctttctagggttatcaacatgaatgtcggtaaatgttctactctaagaacagatgttttactttttttaagtttttagtatgaaaaactgtaaacacgaaattagaggaagagtccagcacctgccatttggccactgtccagacctactgtgtgcttcttggggaaaaactttacagctttgaatggctgagaggtttggaaagaaacagctcagtccccatggcccggatggagagaggatccctgcaggcaggtccccatgctgccaccagattggagccactccttgcttcctttagtcacagtacctgaatgtgcccgcctcctggagagcgtcctggttgcaggcttcccttgccaaccactccagagggtgaaactggctctcttcttgcttctttaaaaagacactgaggcgcatcttggatacccgcaagaaagaggctgtacaaaggcagaaacagacgttcagcatggccgtggctgagctgttggctccggagtgcttctgtcccacctcccccaggaagggaagtccgttggccaggccaattctagagcaaaatctgagagatgctcttagattcccactgtgtcactgcttctgctgagccatggaaacctgagagggtgtcccccaacacacagtgaaatgatgcccactcctcaggaagagcccacgtgggggcaggggcaagaggggtggggaggctcataccgtggcacgcgtcatcctcattcaagaggcccaggaggagcaccaccctccgcatattgcgcgtgcagctctcgttctggtctctgagcatgcccacggcgctctgcacacagcttctcagcagcctggtggtgtccaggatcgacacctgttggtggagacggttgggtcatccgtttctgccactgacacagtgggcaaaagccaaaccgcccgtatgcgatgagggtctcaatgcagcaaacagcacagggcggcggtcctcacggacaaagaagagacgccgacctccgccctgcaccccccaaactgccggtgcagatgcccttgacccccagtaaccagcaacaagaccgtcactgtgtgaggaaagtggggcgccatcctcacccctgcacagcggcggcgactcctctagctcccaatgcaaaagcgtttaaagatgcagctcagaagcatcaccagcagcacaaggggaggtcccaagaaccagaacttacatcactgcctccgagttcagaggtttcctttcccaccttctcagaactttctgtttccatggcctcctctgccacctctgccacctcccctgatgtgctggcctccgtctccatcgcctcctcatggccgtcttccgcccggtgttccaagcccactgcagtcgaagcaaacgtgattgcgttaccactcagaaggtggcacagggactggcagcggtgccatctgggagtctgtgtgctcagcctccgagtgcaggcttccccggcccctgctgtggtgctaggtccccagatgagagatcacggtcatgaagatcagcccccaaggcagccccttccttccagcctgggctctggcgtgttctaggtgctcacttccatggctggcctgctcacagagctctacctcagcctgtggtaagcgcacctgctcggccctggtgctctatgatgagccaccagtcagttctgcagatgtgtccccgagctcctgccgagggacgaaacacggtggccctgctcctagtgccatgtgcacgccacgctccacacctgccatctgcccttccaccacctgctcccccaggggctccgcctcgtgactcacgctcaggcaagtctccgggcgcgaacagctggctgatggtgacatgctgcagcctggtcacatcagaaaccatgagggtggatctccggaggtcatcgatgtggacagactgccacagccctgtgaagagtgaagccacccacaactgtctttgtgtctttcccggctgctgctcagccctaagcagggacattgcacaccctggcttgtcattatcttgctgcgcaatgaatgactggcaccctgaagccgaaaccctggaatgggcctgcgcagaaaccacccaacccgatactatacacgacccgattctatgcccatcgacagcttcaccataagcagcaacggtaagacctgcaatggccagcgtgggaaggacgcatggataaggcctgtggttctttcacccatgcattgttgtatttgctgtatcacagttagtgaggggtgggggacactggcaaggtctgccttccattctccacgaaattattcaagtaaacttactttcctgtttctggaataccaacttttctatgtcataaatagctggtgaccattccttggaaaaaaagagatctgaagatagtccgacccccgccactctccctccccgccaaacaggcgtatcggtgcgttcctgacagtgtctgtcgggagtcgggagtctccacgccgtgtgacctacatgctaagaggtgaggagcttgcctagagtcagtccaggagaggtgcacgcagcctcccatcccaggattcatgttttcatggtaatcagtggtaagaaatctaattgcatctggaaagaatcctcttgaggttaacaataatattctaatttcagactgtacaacacagaaccaaatgagaaacagttccaacatgacttaaataaatacactgactgggctgggtgcggtggctcacacctgtaatcccagcactttgggaggctggggcgagcggatcatgaggtcaacggattgagaccatctaggccaacgtggtgaaaccccgtcactactaaacatacaaaaattagctgggcatggtggcgcacgcctgtaatgccagctacttgggaggctgaggcaggagaatcgcttgaacccaggagattgaggttgtagtgagctgagatcgcgccactgcactccagcctggtgacagagcaagactccatctcaaaaaataaatagatacaaataaataaataaatacataaataa

SEQ ID NO: 6118 - DNA, 5309 bp, Homo sapiens
gggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcagtagcttccctcgagaccagaagccagagctcaccctcccttgtgtccaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgcgggttagatagaggtcatcagccgggttgattctacaggttagatagaggtcatcagctgggttgattgtgcgggttagagatcatcagccgggttgattgtgcgggttagatagaggtcatcagccgggttgattgtgcgggttagatagagatcatcagctgggttgattctgcaggttagatagaggtcatcagctgggttgactatgtgggttagatagaggtcgtcagccgggttgattgtgtgggttagacagaggtcatcagctgggttgattctgcgggttagatagaggtcatcagctgggttgattgtgtgggttagatagagatcatcagctgggttgattgtgtgggttagatagaggtcatcagctgggttgattgtgtgggttagatagaggtcatcagctgggttgattgtgtgggttagatagaggtcatcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccatggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaa

SEQ ID NO: 6119 - DNA, 5474 bp, Homo sapiens
agatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcttctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccacggccaactcctgtcccaggacatcatctccgggcccaaaacttactcaagtcagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctaatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggcctcccgagtccaaagctcctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccctccgggcgttctctccgggcccagctcttcttcctggttgggtctccaggcccgattcctgcctctcaacaacctctttggactcagtgcctacccatctcctggcggccttggtcggtccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgaccgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgcccttgcctcccaggggcctctccaggcccagctcttgcccccacggcggcctcccggggccaagtccctgcctgcctcccagcagcccgcgtgcggcccagctcctccctcacggtggcctgttgatgcccaactcatgcctctggcaccctgcccagaggcgtgagcccctgcctcacactggctcctcccacgctgagagaggtcagtgtgagcccttgcctcacaccggcccctcccacgcggacagaggtcagcgtgagccccttgcctcacaccggcccctcccacgctgagagaggtcagtgtgagccccttgcctcacaccggcccctcccacgtggacagaggtcagcgtgagccccttgtctcacaccggcccctcccacgctgagagaggtcagtgtgagcccttgcctcacaccggcccctcccacgcggacagaggtcagcgtgagccccttgcctcacaccggcccctcccacgctgagagaggtcagcccgagccccttgcctcacaccggcccctcccacgcggacagaggtcagcccgagccccttgcctcacaccggcccctcccacgctgagagaggtcagcccgagccccttgcctcacaccggcccctcccacgctgagagaggtcagcccgagccccttgcctcacaccggcccctcccacgctgagagaggtcagtgtgagcccttgcctcaccccggcccctcccacgcggacagaggtcagcctgagccccttgcctcacaccggcccctcccacgcggacagaggtcagcctgagccccttgcctcacaccggcccctcccacgcggacagaggtcagcctgagccccttgcctcacaccggcccctcccacgctgagagaggtcagtgtgagccccttgtctcacaccggcccctcccacgcggacagaggtcagcgtgagccccttgcctcacaccggcccctcccacgctgagagaggtcagcctgagcccttgcctcacaccagcccctcccacgcggacagaggtcagcgtgagccccttgcctcacaccggcccctcccacgctgagagaggtcagtgtgagcccttgcctcacaccggcccctcccacgcggacagaggtcagcgtgagccccttgcctcacaccggcccctcccacgctgagagaggtcagtgtgagcccttgcctcacaccggcccctcccacgcggacagaggtcagcgtgaccccctgcctcaacaggccaccgtgagggaggaacaggatcgcactcgggctgctgggaggtaggcagggacttgggcctgggaggtcgcggtggggcgagagctgggcctggagactcccctgggaggcaacagcggggtctgcagacacccttctccagccggagctgggactgttcagtcactgggagaagggatgtgggtctgaagagcttggttgcagaaactttggggtctacaaacgcaggcgggagctgagccaaaagagcttgtttgctgggaggtgggagatgcagccaggaggaacagctgggcaatgcgggaggcagaggccaggcctcctcaagttggcctctcagacccacttgcagcctcccggcgccccctccgggcccagctcttcctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctggccctccgatgacatctgcaggccccaaatggcctccggtcggtgggctcctctaggcccagcttgggcctcccggcggcctccgcaggcccaaatcgtcccgaagtcagtctctccaggcttagctccagcctcccggcggcctctgcaggcccaagtcgtcctcaagtcggcctggaagtgggcctggaagagcagcaagtcggcctccctgggcccagctccgtcctctcgacggcctctccaggtgcaaaacttcctcgagtcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcgtctcgaaggcctgcacgggcccagcctcggcctcggcctcacagcggactctccacgcccagctagctctcgcctcactgcggcctccccagtccaaagctcctgcctttcggccacttcggcaggtccagctcctgcctgccagtggcctctttaggcccagctcattcctcacgtcggccattccaggccctgtttttcccttccggcagcctcttggcctctaatttgtttatcttttgtgtataaatcccaaaatattgaattttggaatatttccaccattatgtaaatgttttggtaggtaatttatttggagtgagtttctgcgccaagcccgaattttttattttattttccttattatttggtgttaaacaggtttaatgacggtcatggcaactttttggcacaatgaaaaatatcgcccacga

SEQ ID NO: 6120 - DNA, 1836 bp, Homo sapiens
acaagaaccggcagcggcggcagcagcagcagcagcagcagcagcagcagcagcaactggatttgctttttcaccagaggatccagatttccctgtggcctcgcaaacaaaaaagaaggaagacggagcagcacagtcatccctttgtgaaaaaggcattcagagacggggtttcaccgtgttagccaggatggtctcgatctcctgacctcgcgatccgcccgcctcggcctcccaaagtgctgggattacaggcgtgagccaccgcgcccggccttagctggtttttcaaaagtcatggcgtgtaattgtccgaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaggaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccagccacctaagctgaagattcccttgagaacaagtactgtccc

SEQ ID NO: 6121 - DNA, 2682 bp, Homo sapiens
aaagaaacttgaggcagggctaactctgcgtttgttatgattaggctacaggaaacccggagttgctgggaaatgagtcacagggtcactcagcctttctgtggcgaaacatcgacttcctacgacctagaaatcgccgccagggctaggctggtgtttgtcctaagtgggtacttgcttgggttgagaaatcacattttggctattccccgacttgaaccaggggatagaaatcgtagtcaccggctgggcgcagcggctcatgctgtaatcctggcagtttgggaggccgaggcgggcagattattgaggttaggagttcgagaccagcctggtcaatatgatgaaacaccgcctctagtaaaaatacaaaaattatccgggcgtggtggcgagcgcctgtaatcccagctactcaggaggctgaggcagtagaatcccttgaacctggggtgcggaggttgcagtgagccaagatcgcgccactgcactccaggctgggcgacacggcgagactctgtctcaaaacaaaacaaaaggaaaagaagagaaaagaaaaagaaacgcaggcaccctgaaatcgaaacttgttaggaccaacaagccaacgacagacgaatctgcggggtcctgcgacagacacgccagccccgccgccacagcacagggttctggaggtcgagctgttctgcgggttctgcggcggcgctgggaagagacggcgcccgggcagctcccctgtcaccggcttggaggagcggcgggctcccctagcccagcgccgccgccgccgcccgggaacgccaggctcaccccagctggggaagctccgaatccctcagatcggcgacctgagtgctgtcgccccgagaaaatggaggcatcgagcaacgagctgtgctgagaccgagagacctcagttctgcgaaatgtcggtgcctggagcttgcgaatgactgcggccggcgggttgtcaaggacaacattccttatggcgcaaccaacagcgctgtcaccaagaaactggactctgagaaaaaagagggtttcggccaccgagaaactccgtgccacatgtgccgtgacagcaaaaccgcccgctccgcgccgctggtgaaagagctaacgaacgccaggtgctgcgacagtgacaccgggactagaaggcctcggatggagaatgggacgcccagagcaagcaggaaaacgttttgtttggctcaactagcgctgtcgcaaccggaaaactgtcaggccagtgctgctgcggatgtgagaaaccggtgatccgaaggcggagtggcgctgggcgctggactcgctggtgtgaaaatctggctgctctaggacccggcaagcgcgggcaccaggcgaacgccagcgactttgccagacaaatgcatgtcttttttggtcgccattcaaagatgcagccggcagtcagccccggctctgagaaacaagtggaggtgtcagccataaaccctccgttcagggaaaagagagtcgctgcgacggatcgactggccgttgggtggaactttctttggtggcctagtgactagaaaataaaaacgaaaacgaaataaaaaactgctactgacattactcccacgctccctcctcaagtcagtggcttcaggcttaagaaaacctgtatttttcttggctgatccgtgatccctaattactgagggccccgcgacccaccaagtgcgattcgcagagggaaaggagctggaataaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcaggtgaacttgtaagtgttgaatcctccctctcctcactgttcaatcagactgaggcctacttcctttctgataagaaatatggaactgccattgctcagtaggaaaatgtcctttctacaagcattcatatttcaataaaaatctgcactttgtgagttgagccccctcaaagagacctacagaccctgccatgagcatctccatccacactcatcatttcccattttcaccacttctgctcctgtgcaaaccagtactatccttttctgggggatcctaggcagaagcgatggcaggacaaaggcagagaaggcactgccagaggtcctgcatgccagtaaaactactcatgtcagctgttctgcaggatcccatgagaag

SEQ ID NO: 6122 - DNA, 1795 bp, Homo sapiens
acaagaaccggcagcggcggcagcagcagcagcagcagcagcagcagcagcagcaactggatttgctttttcaccagaggatccagatttccctgtggcctcgcaaacaaaaaagaaggaagacggagcagcacagtcatccctttgtgaaaaaggcattcagagacggggtttcaccgtgttagccaggatggtctcgatctcctgacctcgcgatccgcccgcctcggcctcccaaagtgctgggattacaggcgtgagccaccgcgcccggccttagctggtttttcaaaagtcatggcgtgtaattgtccgaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaggaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccat

SEQ ID NO: 6123 - DNA, 437 bp, Homo sapiens
cacggcccgggggacccaggcgtcccgctcctcgccgggagcgccccttcccccgagtggcgccccagccgtggcagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcct

SEQ ID NO: 6124 - DNA, 2591 bp, Homo sapiens
ctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctggtgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtcagactcctgctaagagacagtatcaagaaagataacttcaaaatacactttctggaggcctggcgcggtggctcaggcctgtaatcccagcactctgggaggccaatgcatgtggatcacctgaggtcaggagttcgagaccagcctggccaactgcctgaaaccccatctctactaaaaatacaaaaattagccaggtgtggtggcgcaagcctgtaatcccagctatttgggaggctgaggcaggagaatcgcttgaacccgggaggcagaggttgcagtgagccgagatcgcaccactgcactccagcctggacaacagagtgggactctgtctcaaaaaaaaaaaaaaaaaaaaaagtacagtttcgggatttcataaattgggttccctgagggtcatttggtgaatccgggttaaagaaccctggtctgcatcactgtccttgtttgtttttcagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactggaacacctttttcttggtctgttgtgcacagcccaggtttggggggtactggtcattgactgtttcagaagccgctgtgtttggggaactgccctggcggcttcagaggtgtgtgtgggttgaagggcaggcagctctgcaatagacctcaccttggactaacac

SEQ ID NO: 6125 - DNA, 1903 bp, Homo sapiens
gacatttacaagaactggcggcggcagcagcagcagcagcagcagcagcagcagcagcagcagcagcagcaactggatttgctttttcaccagaggatccagatttccctgtggcctcgcaaacaaaaaagaaggaagacggagcagcacagtcattcctttgtgaaaaaggcattcaggtaactgagtgactcagcaagcctgggtcttggggaaattacgaatacctggttgaaggacagtcctcaggcagagcccctgagacctgttgaactctagagtgtgggagcagaggagattcagggcctgcccaggggcagagtgcccccaggactcgccctggctcagttaaggactcccctcaggatctgcagaggtgcaaggcagggtgcagctctgcctggactgagctggaaatgcagccgtgtggctgaagtggccacttcctgctttctgtaaagcagccacagggacctgtgaacagagacggggtttcaccgtgttagccaggatggtctcgatctcctgacctcgcgatccgcccgcctcggcctcccaaagtgctgggattacaggcgtgagccaccgcgcccggcttcagctggtttttcaaaagtcatggcgtgtaactgtccgaacagtgaacttcggagatccaccggaggggcgaggccacagctcgaccgcgagcacctgagcatcctgcaccgcctgcgacggccgtcagggggcgcgatgccgcctcacagaacctcaagaggcgcccgggttccggcacagacggcctgcggctccagggggcggaaccgagccgtctcctcaggacctacgcaggaggcgccgtcatccctacagggacacctgagagggcccagcctcctcctcctcaggacctactcgggagacgccgctggctctctaggaacacctggggaccgtggccagggacgacccagcctccttctcctcagctcctcaggaacgactggggaagctgtggcttcatggtccccgaggctgcccgaggaaagacagagtctcaaccaggctggagtgcagtggcgtgatctcggctcactgcaacctccgcctcccaggttcaagcgattctcctgcctcagcctcctgagtagctggtattacaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctgagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcg

SEQ ID NO: 6126 - DNA, 433 bp, Homo sapiens
atggcaccttgaaaggggaaggaaaagaaggaagaacaggtcatcagcctcagacctcaggtggctgaaggagagaatgtatttggtgtctgccatatctttgcatccttcaatgacacttttgtccatgtcactgatctttctggcaaagaaatcatctgccgtgtgactggtaggatgaaggtgaaggcaggtgagatgaatcctcaccacatgctgctatgttggctgcccgggatgtggcccagagctgggtatcactgccctacacatcgaactccgagccataggaggaagtagaaccaagacccctggacctggggcccaggtggccctcagggcccttgcccgctcaggtatgaagatcggacagattgaggacgtcactcccaacccctctgacagcacccgcaggaaggggggttgccatggt

SEQ ID NO: 6127 - DNA, 3736 bp, Homo sapiens
acccggcggcgcggcgtgggtcgggagcgggcgcctgggactacttctcgtttgaaagttttcagaggccaaaagtttgagccggggctgcggaaggatccggctctggcggttgccgcgctcggcgacaactggcgactgaaatttgcatgtgaataagcggaggagcccggggcggaatggggagggcgaggccgcggacagccgtgtgcaccgtgcgctgggccgggcggggagcagctgaggccacgttgggggaccccgggcccggggcagggctctgggagagtggcctagccgtgtgtgcgcccctagcccagcggcttcactccctcccgagggccccgtggccgcggctttaggcgtccagaggatcgatcgccgccagacatccctggccgtgattgcccgagcacttgaccgcgagggatgggggcgccgcggcctctgggcaggggactccgggcgccccgagggagcagccgggaccagtgcctcgcggacggattgtgccccgctcccccaagggggacccgcgtcgacacgctcctcggtcaccgtcctcctcctgcccgggcgccgcctgcctaaggtggccccagaaagcacaaacgggtcgggcggatctgccgctggcgccggcgcagcccttcccacgtgctccttccggctgatttatttctccaccacgatgccaggcacgggcaccctgtgccaagcctggttaagcgccaggagtccaaaatgcctgccatagtccctgcgcaaagttcacggcctcgtgccagggacagacagcgccccctccccaccccaacacagggtggtgagtgcgatggcagaaggcgcgtgtcccggcgcccctcctggagtaggagggctaagcctgccctgcggggagaccgaaaggctgggagggacctaggactgtgggggcctggggggagggctgcagaaaccccagagcatggtggcagaggcaggcacagaaagcaggacaaatctcacacctgaccccagcaagcctttcctggcacacctcttgccaaatgctgagcactctggaaacagccagtgcaggcggcctgtcccgcccctgtagctgctgctgggagcctccctcgcctgcgtcctcccagaatctggcctcacttctgcaggcctggggtaacatcttggggtcagcgccccaggagaggaggcgcctggaggcagcagagatgtttatgtaacagcagccaggcagcctggaggagcagattttccatagaaggaagcgcggggctgtgcagctcccaggctgaggactctgcccaccacgacgtcctctgctcctggtgggtgggggtggggtggggcatagggaggcccgaaggcctcaggcctggtgctgatcgggtgcgggtgcgactgcctgtgtgcctccattggcatctctgcctgtgggccccaggccagaagtaatggcccatgtagcccaggcccgggggccagtcctcagcattttgcggaggggcggcctgggaggggaggaggggatccctggatagggggtctcccctggtctgccccagctgtgccgacagcacctccaccttgggcctccatcctctaccagcagagaagagagtggcccattcggtgtccacccgtcaggccacccagcagccaggcacgctcataagcccgcgttacggatggtgcggccgggtgcacaggcccgagggaagcacaggcctcggcctcccagctcccaacccctgcaccacccacagccgggagtaccccatggacagctgtggccgaggagaagccagggatgagggggatgggcctcacctccccaccagcctgggaagggggtaggcccctggcaagtaggtgagaagctttttcattcacaagttgtccgggctccccattcctctttgtcaggccagcgggtgtgggcagtcgggggaggctggggtcctgacacaacaggagtacatctgctggcctagggcctggagaccttctcctacaggtcgggaggcagccctgggcagcgggcattgcggggactaaagagaaacaagagcaggttgtgtgcagggcaccccagccactccagaaacccaatgggagggtgggggctaggaccccaagaagctgaattggggtgcagtgccgccaggcctcccctgtaggagtcactttgggcttcctgtcccaacttgtggtgggagctggggcaaggttccaggggtaccccgaatgaatggggctgttcccaagctggccagggagcctggaagcagatgagatggggccgcagagcctggtttgcggaggggagaggcagacgtgtcctgcagccctctcttcttcagaggccccctgcgggtgctgaggggagagtggcttaggcgttgcaccccaggagactgaactgggtcagttcccccttgtttgctgccagagaaatgggggtaccattgtcagggtgagctaaggaggccctgctgacattggcccaaccaggcccctcctttgcggctgctgtggggactttcgagagcagagcacacccctaagtgcgtggagaggtaagcacagctggtgagcacacggggacagcgacggagctcatggagacccaggtgaccttaaaacaccccagggccggctccggccccagagagatgtggtccgagtagaggggggtcagcagtgacctggtgggtgggtgtatttgaggggtgcctgtgttgaaagctctgcagtagattctaaggagcagccagggctgagactcccggtgctgagcccaaggcccctttccttcctgcaggagttcatcttggctcttgcagcccccatgaccctgtggcgctggggggcggctagcatgatgctccccatttttcaggagggaagctgaggctcagagacatcatgaggatgccagctcaaggcccagccaggccttggtcctcagctgctgtcatccagtagggtaagtgggacccccaggaggtgttgggggacactcctcccctcccccacactcacagtctgttcaccgcccaaggcagcaggctggactcggtgcagggaccatggcttggcgtggccaggttggagtggcccctgggactgaaagcagggggcgtgggggctctgaggcggggccgagtgcggggacgtcctgtggcgggtaccctgctgggtcctgggtgggggccaccaccaggcagctgtgggaacattccagaccacctaggagtagggccccttcaccgtttgaagctgactgtaaaaaacatctgacctgtgtgcaaagctcaagcccagaggcctccagggtgtccagcctccagggtgcctcctacgcagcctccacgtccccatccactgcagcccctgaccatcgggcacaccgtggggccttcgctggccgccgggcctcaggttctgctgcaccaagtgatttttaaagccccatctgcctttctccacttataaagaacttgggacatttcctcgaggttgggcatttttccagatgtggtttcagtgtctcgcttgctacctggtcccctgtgctgggcggtccgctgtgacgcacctggcagtccttgctctaggatggattcgggccggcccttgttctgagaacagagaacggcccttgttctgaggaggctggggtctggaatctgcttcctggtcccctgctgtgtgcagacagcca

SEQ ID NO: 6128 - DNA, 1569 bp, Homo sapiens
ataccgggtctcacactgtcaccgaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcgagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagttatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgagtaagcatgga

SEQ ID NO: 6129 - DNA, 487 bp, Homo sapiens
gtattgcctccagcacactgtttacattcctactgtgtctcagcatctgttctcctgggaatagaactggtccacctgaacatatgatctgtgctgctgttggtgcaggaggacaggagggaaataagctggaagccatggatgtggagagtctggcttcaagatggagcttgtttacctgcaggttgtcccccaggatgccctcacagcttgtgcgtgacaaagatgtcctccgtgtacacataaggtagcgctgagaagccacgagaaagcacctagtgattttaacataaacatttccacagcattttcaagttctgcgaaaaagcccggtgatagatcagcctcgcggtgtgcagcgccggcagctccgcacttcggacacctgggggcgcccgtgccattccgccggcgactgggactcgtcgcccgggaaacaaagatggggatttaaagaaaagccttcaaaatgcaactccgaatgtct

SEQ ID NO: 6130 - DNA, 829 bp, Homo sapiens
agtggcgcctaaagtctgcaaggaggaggtcgcctctgtgctgtgggtccaggaatctaaggcatcttctttattctggaatgagcctgcccatccctcaggaagactgaaaggaattcggtcagaagaatattattgacttttatccagacttgatttcagtagagttctgggacctgccatatcctatgggtgagctctatccaggtccccttccctgaattacctgtcctctccccactgactgggatgacacctaattttacaacctgctgtagcatctttgctcccactgtgacagtaaactccttgagactggtggccatcttgggaagtgattagattcagaagaggttgagaggttggggcccccatgatgggattagtgtccttttaagaaaaagaagagactggagctcccactctcttcaccacgtgaggatatggcaagaaggcagctgtctgccaggcaggaagagggccctcaccaggaactgaatctgctggttccctaacctcagatttccagggtccagaattgtgagaaagaaatgtctgttgttaaccaatccatctgtggtgttttgttatggcagcacaagctgactaaacaagtgccaaaaccaaaccagtaactcccactttctagtctcggacccagtattaaggaattctggtcacatagtttattcatccatttaacaaatatttagtaagtgcttctgtgccaggcatttttctaggcctggtgatcatttaatcaaaagagactaacacctgctccctgatgcttacaatctgaaagacaataaagaaaaatatagtaaca

SEQ ID NO: 6131 - DNA, 5256 bp, Homo sapiens
cttcctccgccccaagcagccggggcggtgcaccaccggcccccgcttccttctcggggttgggaggcaccgagggcctcgaggggctgcgggactcgggcttggtgtggagggcaagagcgctgcgacgtgcggactggagagtcagcctttgggctggagacacgggagcgggtggctacagtggtttacgttgttgcacggggcgagtagaacgtatccttctttgcgtccaaaatctggttccttgttggatttgaacagattatgtggctcgtcggggcgaaccgagggtttttatttacttggaaagaatcatcacagcccgcgaattcacaagctggatttagccattttcccttagattctgcgccatgagcctataggctgttgaatacgagagaagtgcttttctaaacgagtttctaaatttaccagcagtgtccaggaagaggcccagaacatacatattcagcaccagaaaagactggcacgcaatttttcttgacaaactgggtcttgctctttgaagggtgggtgggaatgtgctgtttttatgagaatgtcaaagaacttctcagaatcacattaagcatgctaattaccaaatattaaatgctaattgttccacacgcagttcgaatgccaaggaaggaagatgaaactagtataagctactcttgacattatgtcagggatggttttgacacgttttgcagcctccacctggaggtggggaacgtttcctgtgtcgtccccagagcagagtaacagcgttgtttatgggtgagagcaagcctcaagcctaggcaacaatgtgccttgcttgcttttaagctccttctaaaggggaggtaaaccaagaccgctaaagaattgctaggtgcctgggcgtgatggttcaccccggtaatcccagcactgtgggaggcggaggcggaggcgggcggatcacgaggtcaagagatcaagacgatcctggccaacatggtgaaaccccgtctgtactaaaaatacaaaaattagctgggcatggtagtgcgcgcctgcagtcccagctactcgggaggctgaggcaggagaatcgcttgaacccgggagttggaggttgcagtgagctgagattgcgccactgcactctagcctgggcaacgatagtgaaactccgtctcaaaaaaaaaaaaaaaaaattgctaggcagctgggcacaggggctcaggctgataatactagaattttgggaggccgaggcaggaggaccgcttgagcccaggagttcgagaccagcctgggcaacatagcaagactgtctctaaaaaataaaaaacattgctaggcaacagcttccatggacttgttccaggaacgaagattattcttgaaatgtccacgtagtggataagacagagtcaatcagtgtgtccagtgctacaggcttgattgggttcaatcctgtacttgggtcaaggtgtttgcctacattgcctgtacttcctccaagacatttctgcctctgggttgtaactgcccgtgtacttgtctgtgttccctaagccagatcataagctctgaagctgaggatggtggctgtagatggcagtacttgtctgtgttccctgagccagatcataagctctgaagctgaggatggtggccgtagatgacaggcctggatgcagccaggtgccttgtggatcagcttgcttttaggtggtgaaggactgaccatagacagtggccctggcattccaggacactgcatgggggaaagtggagggccaggtccatcccatcccctctataagctggacaaagctgctccagcatgtgggtcctcacatgaaaaaggccacattgacatcctttgtcctcctgtagagggagtgaaactgagaggcctcagcctcaagcaggcacagaacttgagacctctcggccagagtgtacagacattgcacaaaccttccaagttcagagaagacaaaagccctgagtaaattacagacaaaaaagcccccaaatatacagcactgtgaatccagaaatgccacctgacttcaggtcacaaggaagaaaaactgattttgccagaagtagccattattgcacagcccagttataatcacaactgacgttaaagtcaggccagatgaccacagaagtctacagaaaaaaaccaggattggccacgcgtggtggctcacgcttgtaatcccagcagttcgggaggccaaagcgggtggatcacctgaggtcaggagttcaagaccagcctggccaaggtggtgaaattccatctctactaaaaatacaaaaactagctgccattgtggcgtgcacctgtaatcccagctacttgggaggctgaggcatgagaattgcttcaacccaggaggcggaggttgcagtgagccacagtcgcaccactgcactccagcctaggtgacagagcgagaccctgtctccaagaaaggaaaaaaaaaaaaacaaaaaaaaacacccccaacaccaaaaaacaaaacaaaacaaaacaaaaaaacaaccaaacaaccaggactgagaaaatcaggctttagcatgaaatgttttcccctaaattcagaccaatgtacctcaaaaacccagttgtaaagcttaagtgtctagtgggttaactatcccacccaacctcctaaaaagtgttattataaaaggaaaaaggggagaaagggtagaggagagaaaggtgggccaatggctactgttcaaggaaatggtttaaatggggctgccacgtggttatgtgtctgtcacgagaggcttgttaagcagttagcacttgagtcatttttctacacttccattcagccaggcagacagctgtggttatgagtgggaacaattttggccattatgtggtgtggcttggttgaaaatgcttatggcaagctgcctaaggcaccgcaaacagcagcatgcctccttgagcacacagtccttctgctcataaattctctctctacctccaacctggccagccctgccagatccctttcccttcctcttggagcacaggcccagccatggcctccactactcagtcactgcacagttcctgacccacacatacccctctatgtgctcaccatcctccttagtcctgtcccaggtgctccccaagtgacctgacattgagctccagctgttgttctttgaacacccaagaccctcatctccaccccatggctgaggagttctggatttggggtttgatggaccagtaaacctctgcagacaccatctagggactgacactgggttgcgaactttttattttgcaagattgaatatttgaaaacaactcaaactcctgtctaaggttcctgtcttttaaaaaacaaacagaaggccaggcacagtggctcacgcctgtaatcccagcactttgggaggccaaggtgggtggattacctgaggtcaggagttcaggaccagcctggccaacgtggtgaaactccatctctactaaaagtacaaaaattagccaggcgtggtggtgggcacctctaatcccagctacttgggaggctgaggcaggagaatttcttgaacccaggagatggagattgcagtgagcgaagatcatgccattgcactccagcctgaacgccagagggagactctgcctcaaaaaacaaacaaaccaacaaacaaacaaacagaaaaacattgtcacacagacaaaaccaatatggaaaacttccaaagaaagggtgcggcatcactttaacgggtgagcacagcggccctggcagcctccaggctctaggtggcactggattctttctgacaagtcctcatctgggctgtcagagacctccgctttgagctgcgctgccatagagctctctggaagtcccttgctcctcagggtccagtccgaatgcgcctttcacgaggcctctcaggccatcctcaggagaaaataatttctcactttggccaggcgtcgtggctcacgccttgcaatcccagcactttggaaggctgaggtgggcggatcacttgaggtcaggagttcaagaccagtctggccaacatggtacaaccccgtctccactaattagctgggtgtggtggtgggcgcctgtaatcccagctacgtgggaggctgaggcaggagaattgcttgaacccgagaggcagaggttgcagtgagctgagatcgtaccactgcactccagcctgggtgacaagagcgagactgtctcaaaaaaaaaaaaaaaaaaaaaattccacctgtgaggccgggcacagtggctcacgcctgtaatcccagcactttgggaggctgaggtgagtggatcacctgaggtcaggagttcgagaccagcctgaccaacatggtgaaaccttgtctgtacttaaaaatacaaaaataagccgggcgtgatggcaggcgcctgtaatcccaactccttgggaggctgaggcaggacaactgcttgaatccaggaggtggaggttgcagtgagccgagattgtgccgtgccattgcacttcagcctgggcaacaagagcgaaactccgtctcaggaaaaaaaaaaaaaaaaaattccgcttgtcaattttttatagcagagactgccatttttaggcagtgactgttctttgtccttcgatgtctgttcttcccaaattctatagtagaaccctgggcttttagttggacacacggatgactgaaataatgatatttcctagtaccccttgctgtggtcttgtgactaagttctgaccaatgggaagttgaaatgggcagtatcctattcaaagagattgggtgctgttctttcctccttccagcagactggaatgagaatgtaatggctggagcaagggcagtcaccctgcaccatgaggcggcagccttgtgtttgagctgaggatggtaaaacaagataggagcctgtgtctgatgatcatgagcatcacactagctctgggccaactatgtttacaaaagaggaggaaaatcatctctcttgttaaaagtcactatagtttggcttttctgtcattttcaaccagtctagtcctagctaaaacaaactccagcctatcttaggacagggctgttctctgctgttcaagagtgggagctctctgacggcagtgatgtgtgatttggcttggtaccccccaaaggttatcatatacagttggcaatctcaatactttgtgggatgaatttcaaagaaaaaaggtttctaggtt

SEQ ID NO: 6132 - DNA, 653 bp, Homo sapiens
aactttccacaggtatcttaaaagctttgctcactcatcccttctctgacttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttattggactccttgtgcctctccttggctggggaaatcagaatacacagtggtatcccacttctaagatgcctgatctgaaggacagtaaaacaactgacctttgccagcatgtaaaacacatggtttaactagtcctccaggaacaacactgagcaatcctgacctgggactactttactcggccatctcctacttgagatgctccttgtctctctgttcaaggacaccttttctgagcctttcttgaacaagagtggaggaccgatagggcgattaaactgtccttgacacaactttagagcttcaactgagaatctagaagagagtagatggaaaaatatttttccctcccctccaaatgcaaggataatcttacacgagtccaggaggaaggctcattccacactaagtgttctga

SEQ ID NO: 6133 - DNA, 216 bp, Homo sapiens; identical to SEQ ID NO: 5870

SEQ ID NO: 6134 - DNA, 2468 bp, Homo sapiens
actgccctaacagagcaggtggggaatgttctgtttactccacttgtgcttctatttggccaacttcgcctcttcaattaaaaggacacatgctgttaacgggtgctgtggattacagatgatcgcactctgggcacagtcctctggaaatgcagatgcccgtgtggaggaaattctggcgggagaggagcggcgactcgccgctctgcttggatctcaaggcatgaggttctgggtgtgcctcgcagcctgcagagccatgtggggccttgctgccagacgaggacgggctgaagacagcagctcgtctccagtggacgcctccaagttcccatggaggggtgggcagcatcgcaccaccatgatgccttgtctgctgcgggtgggagttttcaggccctgtcatgtgagacccacgggggatccttcctgcgatgtgcagcctccacgactcggcttctccagagtgccagatacacaggtggcattttatggcagtggtcactgggacccaactcccttctctgtacacagctgtttttttaatttccaggtcagaaaaattatcttcctactttgaactctttctcctttttgccaaaaatgtttctctcttacaatgcagaagcagaacacagctcctgctcttgaaatactggatggatgtttcagagggtattgtgaggcttggagctccagccagtgacattccagccacatccttctctcctggctccacttcacagaggctggctgtgtctctggactacacctcagagctaatctgctttctggaagggtcgtgtttacttctgctggtgctgtgcatgtaggagacagctgtggccagccctgtttccctggggaggtggcagaggcggtaccatgagcaagggatgcagatgctcaagggggaccagtcaggggacacggggagggtttggcctctccagccaggggctcgccacctccatggtataaacatccatgtgaacaaaaaagttctaacaagtaccagcacactgagaatattttaaaccacaactatcgtggaaaatctgggagggtggttcctaggtccagggtggaaaagtagctgaaaacctggtagggtttgaagaacaatcagaggcggccttccacttctgagaacagttcctgtgagtcacctgatgttgttctagattaattctatcaaagacagtgttggtcaacccagctgcaggcacttgatttcctctaaaagctctggataacagaagcagagctgtgaagaaagtcaagttgaataaaatgcttccacttaaaagaatagggcttttccttgaaatggtccactggatcgaccatttcctctcatttattattattatcatctccattcccatgcatgctatttagacaaggaaggctggaagcaagtgacaggtgcggcagtgcgcagcaaggcctctgcacctggcccgtcagtagggccggcacgcagcctgactactgagtttcttctgcctcattcctctccagaggccctcaacttacaatagagacccaggagctgggagatgactgaatctgttaacatgacacagaaggactaacccataaacatgagcgtgaatgtcttttgttgggggactaaggagatgacactgaaaaggagaatcacaagccaagtgccataagcagaccacattccctgcaagctgccctgctaggctttatcccaaatcaaagaaaaagggagaatgtcttaatattctcacagatttgtaaccacttcactggggtaagttttcctttgtatagatgacggattatccttctaagctgcaagctgataaatgagaagctaagtataaaatatctagaactaaggtagatgaagatgtctatatgtgcactgggtgtcacttatatatctgcctgtgttattaagggcacaaaggttgtgtggggctgtgtaaactatagatattaggaatacagattaaaacagtaatttcacaatgcaagtagtgccaagccacgaaaatatgcctggagcatcttctcttttctctacttcacagaaaatatttccatagacacttttcaccaggcatctgcagctgtttttttttttttaaacaatcataattttaagcactatatggtaagccatttggaagccattcgaattatgcattaaaacaaggaaaaataagatgccacttgacatacactgaaacacataaaatcagatacagactcttgggtggaaaaagtatgttcttcaacttagttcagatgttaacatataaaacatgctcagggaaccctgaaaaaatccagaggtgaacactctgatggtcaatcacatgtgttccttcttctgatctggatgattcttacatttttagggcgctgtactgttttttagccctttgactcattaatgtatcagggaataaaaaggatatcaaactcaa

SEQ ID NO: 6135 - DNA, 1957 bp, Homo sapiens
agctcagcatactgagcctaaacctccctcaagagtggcaataggggcttcataagagactcacttttcgtgtgtgtcttcctctgcagaactaatgacagagtccatacctcgaactcaccagctcggctcggtctgttccttctggctgactgagctctgtctgcaccttggagcagatatttgggattttcctttccattcccaccacctacttgaaaatgcttttattttctgacatttgatccttctccctaatcggcaggccagccctgtccattactacttcaagttcttgtctctggaggcctcggtgatctagagctcagcctcctatactcactttctaagggaaatgaggaaatttgaagatttctactgaaacaaaaggctgcttttgcactgagacacccaatcccagacccaggtacctggcttgcatcttctaatcacacacagcaacatactccaactgagactgagcatgcttcggggaaaggcagtcatgacatagtgtgcctggagaaaggcctgacttattttggggtcatagtcggaaatttatacttacacaagggtcaactaaggtattgttgtgagattccagtattctctgttgaaaaaaacagaaagattggtacaatattgagtgtgatttttcattaaccccacatttgaacagacttctttatttttaagggattcatgccacagcccttcttttgtttcatgtctgcttttatggacctgtacatctaactgaagaataaaaaagcactaaattatgtgtcagtgacagtttggcccaatgcaagtgccatttcctggctctcacacccaaggcaggccttcgtgaaaccattcagggagactgagctggagcaactctatcggtcctcctacttcaaggggcctgcaggcatgtttgtctaaatttggaagtgtccaggtgcagtggctcatgcctgtaatcccagcactttgggaggccgaggagggcagatcacaaggtcaagagatcaagtccatcctggctaacgtggtgaaaccccgtcactactaaaaatacaaaaattagctgagtgtggtggcgcgcacctgtagtgggctgagggaggagaatcgcttgaacccggggggtggaggttgcagtgagctgagattgcaccattgcactctagcctggtgacagagctagactctgtaaaaaaaaaaaaaaaaaaaaaaaaaaaaaaaaaaaaaaaaaaaaaaaaaaaaaaaaaaaggaagtgtcattccatccagagaagctgcaaagggaatcggccgactcttcctccacagctcccagtgaccacagggcccagagtcttggacaccatgcaggtgtcccaggaataactctaaccctttctgcagctctccaggaacacatctttgaagacaaaatgcctccaagatccccagtactgtagctcttctcctgaagcaactatttccagccttgaaagttatcagctcaggagaggaagcactgcaagcagctcctgggccctggggtatggttgcagattcatcacctagctacttgtttgtggtgttatcatctttttttccctgacatattttggaacttgactacatctgatatatttctcaacatgtggcatatgctctgattgagtttggttcactgcctgtaatcccagcattttgggaggccgaggcaggtggatcacctgagatcaggagttcaagaccagcctggccaacatggcgaaaccctgtctttactaaaaatacaaaaattagcttggcatgatggtatgcgcctgtaatcccagctactcgggaggctgaggcagaattgcttgaacctgggaggcagaggttgcagtgagctgagatcgtagcactgtactccagcctgggtgacagagccagactccatctcaaaaaagaaaaaaataaataaaat

SEQ ID NO: 6136 - DNA, 4482 bp, Homo sapiens
cagacggcggagagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatcggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaa

SEQ ID NO: 6137 - DNA, 2009 bp, Homo sapiens
atccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtaagtggactggaaaccactgtctatgctaatcttatggactataatatgtatgattaaatttggctggagcttaacaaatatatggttatgtatcactctggtcagttgatttttcccaaaggctacagttttgtgttcagttgttacatttggaggtgtaagggtataatttagtggggttttttagaacacgtaaacaaatgtctgtagtatatttctttaataacttgatttctcaaagtagagttaccatattgaaaaaactgcttaacattatattttcaaatgtatttacatatccctaaaagagaacagtttaatttcaatcctaggtttaataaatttgccatatctttgaaaaagcaaaaaaaaaaa

SEQ ID NO: 6138 - DNA, 2536 bp, Homo sapiens
ttcactcgtccacccgcctgagccaacttgcccgcgactcagagtgtgtctggactccgcttcctccaatgccaaaggaaaatgtctataatctcactcttcagcgggaagcgttggactccgcggtggtccttgactacacacaccgcagtgcccaccgggaacgtattccatatctctgagcgcctggtggggaatgtggactgtgaccctgactggatgaaatgtatcatcagcatggattctgtgataaattacaagatacaaactcaaaaggaactgctttctatgtgcctcatattttaatgtttctcccctttgtgaatgcttaggtgagactgtagtcatgaaaactgagtaaagactttattacacacattactgaggcttctctccaatgtggacattctgaagttgaagacttgaggcctgaatgaagcacataccaccctcctcatacttccgtagtttctctcccgtgtggagcttctgaagcataataaaattcaagtgatccagcaattctattactgggtatatccaaaggaaaggaaattagtatgtcacggagatatctgcactcccaggttcattgtagcactactcacaatagtcaagataaggaatccacctaagtgtctatcaatacatgaatgaagaaaaggtggcatatatacacaatggaatcctctttagacataacaaggaaacaaaattttatcatttgtggcaacatggatgagttttcaaggacattgttaatataagccaagcaaagaaagagaaatactgactgtcctcactcatatggaagttaaaaaaagttgattttgtagtagagagtagaacagtggatgtagacaggcaaggaagtgtaggaggtaggtgagatggccaaaggttggccaacagatacaaaagaggtagaggggaagaataagttctactgttctgcagcactaaaggtgactatcatcaacaattatttacaaattgctaaaaatgtgttgtagtctcacaaatgcaccacactgtaacagtctctcttatcccccggagttcttaatctcacgtccaatatgattaagaagcacagacacaagggtgaaattggagtaaaagtttaataagtgaaagaaaaaagctctccacagtggagatggggatccaaataagttgcccagtatgaggctggggtccggggtttttatggactgggaaggggaaggaatgcacttagcctgcgggctgtcttggagaaagcgtgattcagcttggtctgggaccttggcccgggaccaatcaggaaccgaagtgatgattcataagggctattcagcttggcccgggaccaatcaggagttgaagtgattattcctaagggctattcagcttggcctgggaccaatcaggagctgaagtgatgatttacagaggctgggcttttccttttccacaaaagaaagtgccaacctgaacctactgaagcccactgtgttcatgcccacaaaagaagaaactttttcctcggagcctgctgattatacaaaggacaaaggcatttctgtgtctggtcttgttcccttaactgagtgagccggaggtttgtgcgagtttttacctgaatgggctggaggttcttctatctgtgcagccatgggcatgtctccaggcacaatcccctgtgctagttcccttatcagtgcctgtagcttgattgtcttccccaggctgctttttgtgttatgtggggatgagacactgacccgtttggctgggggtctccagggacccttcccttgctgtctaccaactcctctcaaatggattttgaattttccaacacaaagaaatggtaaatgtttgaggtaacagatacaccaattacactgattggatcactataaattgtatgcacacattaaaatagcacgttgtaccccataaatatgaacaattatgtgtcatttagaaataatgataaaagtatatccagattcaagcgcctcttgtagcgtctcccacaatcctcacatttggatgggttttccccactatagtctctcggctggtctttacggtatgtcctgtgtacaagcctctttccacagtcctcacatttgaatggttttttctggcagtggagtctcttatgattcaaaatacttgaggcccggctaaagttcttcccacattccttacaattataaggtctctctcccgtgtggaccctctggtgcaagtcaagattaaacttagtaacatagcccttcccacactcctcacatttatatggcttttcaccactgtgggatctctgatgggaagacagttgtgaatttgtataaaatccctttccacattcttcacatttgaagcttttttctccactgtggactcgctgatggttcaaaaggcatgaggaccatctgaagctcttcccacattctttacaattatatggtttttctcctgtgtggaccacctgatgcttataaaaatctagcctaccaataaagccttttccacactgctc

SEQ ID NO: 6139 - DNA, 4241 bp, Homo sapiens
gctgatgataccaccaccaagaaatcatcaccattaatattttggcttttttgttttcagattttttccattatgaaattgttgatatttgatcctcttgacctataaaaatgttaatatcatatagcttactcgaacatatccaaataatgtcatatatattattttatgtaccaaaaagcatactaaacagattgttttatagcttacttttctcatttttaacattataatttaagcatttgttcataatattaaaactttttgaaaacattattatgaatgactatttcaatatgtggatgtaccacaacttacctaatgatttacctactggtaatcattgagttggactggttggacatgagttgtttctaatttgtcgctattacaaataatgctctgataaatatgtataattaatttgtgtttcagattatttttatttctagaaatgagattcttggttataggctaaatatattttcttggtttttttttttgttcatttgtttgtttgagatggagtctccctgtcacccagactggaatgcagtggcatgatcttggttcactgaaacctctgcctttctggttcaagcaattctcatgtttcagcctcccaagcaacgtgttggaccttccggagcttctcagaagacagagggttttcttttgaggtaaatttgatagtacattttgatagtacgggaggcgatacggcatggtgacagaaaagcgccggcttggttagcaggaccacctggcagggctgcaggctgtgccacttaccaggcaggggaccttgggccagctgcttggcctcactcaccctgtttctcagctgcaattgggatgaacagactgcctgcttcggggttgcctaaaactcacattggttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgaggcttgcatttgtttctgagaattaaacgttatgttttcttcaatctaaataggtttgcttgtacagccttgttgaatggttttttttttttttctccatgataaatgactctcaacttcttttccctcatctaattgcttatctacatacaatgcctggaaggaaataaatgtaatggcccgtagcaactggccttcaggtatcaagtttaagtccctttaagcagaacagcaaattgagcacagaatgaactggtttcatggtagcgtactgcaattagatgcaagaatagggaaagcagggtgcttcaagtggtgacacaattagtatagcactgagggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctctcttgggagagaaacaatgaaggcctatttggcacttttatttctattcaaggaaccagactgtgaacaagtttaccatttagtcctttggactgtgtcttgaattcatccctcttctccattctcaccagcaccatcatcatgatggctaatatttcctgagcacctttcattcaggcatgatgccaggtgcaccaacttacttaatcctcatagccaccacctgagcaagctcctgttttataaatggaccagttcttgttgctgttgtacaagttattttctttctataacgtcctccttgtcctccttccacattcttaaagaaactttcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctcccattatgggaaggatacatgctcctactagtaaatttagttggtagaaaaaaattatcactatctagactgctttccctttagtctttatgcatagctttctgtctgcctatttttactttgtgtttgtaacttactattataaaatatgcatctctatgttcattgtcaacattatttacaataacatggagtggatttacatgtattctctatatttggattaaaggagatagagtatgtgaaattaaatgggagaagtatctgatacataacaggcaatacaaatattatcacatagcgtcaatttatttgtgaatattgaaagctccaaaaaagaaaaaaagtttttttttaattcccgtaattacttattgcagtattgtgttcatacaaactgctcagtcattttggagaaataacaatttttttcctcatcatgaagtaaggtatgctcactgcaaaaaaaatctagaaaataaagaggaacatgctaaagaaaagaatactcccatataatctctgtcttcataaataatcttttgtaacgcttatacactgctggtgggaatgtaaattagttcagccattgtgaaaagtagcgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcaatagtagactgaataaagaaaatatggtacatattcaccacagaatactaagcagccataaaaaagaaaaagatcatgtcctttgcagcaatatggatggagctagaggccattatcctaagcaaactaatgcagaaacagaaaaccagatactgcatgctctcacttataagtgggagatacaccatgagaacacatgaacacaaaaagcggaaaaagagacaccatggcctacttgagggtggaggctgggaggagggagagaatcaaaaaacttcctatggagtactatgcttattacctgcgtgatgaaataatcactttgaacattgtcagtacattatcttctaatctagactcttttctatgttctatatgcacacagaaatacacatgcaaagctgaacacatatgtgaaacaaaattcagacactcaaattttccgccaatacatgataaaatcttgcacaatagcttcctccacagaggaaaatgtctttactacatcttaaaaatggggtaaatgaatagttaggctcttcagtgtaataatcatggtaaatattctcaatgtgcgaaaatacaaacaaaagactttctctcccagcaaatttagacccacatgaaaatttaagcacaatcattttaaacgaatttaccctggagcttagtggttcgagctcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccgtttgcttcctgtgaagtagttactaataatcactgatgtcgctttttaatttcatacatcctttaactatcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctga

SEQ ID NO: 6140 - DNA, 3312 bp, Homo sapiens
tcccagcagcgggacgctgtcaccccgactcaggagctcctgggcccgcgggctcccggaagctgccgaccacgtgattcgctggctcagctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatccttcgccagatctggttcttgccacgttcctacagcttacaggcttccaagcctacaaactacgggtgacacacctgtaccaactgaagcagcacaatattctggcatctgttggagaagatgaagagggcatcaaccccttggttaagatctggaacctggagaagagagatggtggcaatccactctgcactcgaatcttccctgctattccaggaacagagccaactgttgtatcttgtttgactgtccatgaaaatctcaactttatggccattggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggagcttaa

SEQ ID NO: 6141 - DNA, 487 bp, Homo sapiens
atacacctccacctctttgagttcaggcttgccactgtgactgctttggcctttggaaactgggctgaagggacagggtgccagttctaggcagaaactttgagatccagggcatgactcatcacaagcagggagttccttccagttcttgataaagataaagggagcacccatggacttgagtaactgcagaggagcaccgtggtgcacagatgtattcccacagttgccagctgtcatcacgtcttccaccacaggaatggagccataggagcaagcctcatagattcgatagcattctgtgtttactccgaccgggcacaatgtgagatcactctgaagcaaggcatcttggtaattcttaagactttcatttgtttcctgaggctgccagctagaaaatcagaaaaacaactgtagttttcactttactaagtatatagtttgtgaacaaaaataccttatcttttaataaaatcagtttcag

SEQ ID NO: 6142 - DNA, 3732 bp, Homo sapiens
actcacgcctacgtactcagtcaccagcggaaccctctccaccaggctccgcgtcgaggccctacggggcgtcaatacgcacgcgtactttgtgtcccaggtagctcgtctcttagccatgtacgcctctgcattccggtcactgggagcggggccgtgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccaggatatttcaaggtgtcagagatgaccatctcccaggagccaaaggcaaagactagaactctctttggaaaaggttaaattatttactacacaatggctaagatttattttagcaaaagatataaaacaaaatcagcaaagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacactggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatgtggaaagtccttcagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagaggtttttcttcgggtgcatttatgagagttcaccagattttggaaatattttctattctgtaacctaccttttcatttacataacagtgataaaagctttaagtttgatcacatccaattaatcacattttttaatagttatgcttttatttgtttttcagacagggtcttactctgtcacccaggctggagtgcagtggcacaatcatggctcactgcagtctctgcctcccaggctcaagtgatcctcccacctcagcctctcaagtagctgggactacaggcatgtgccaccacacctaatttctatattttttgtagagactaggtttcaccatgttgtccaggcttgtcttgacctcctgagctcaagcagtccatctgcctcagcctcccaaagtgctgggactacagacatgagccattgtgcctgacctagttctgctttttatgttctaagaagtattatttattctatgctgagcttacatagaatttcttccatgttttctatagctatagtgtatttttaccttttactgttagatctatttcatgtttttattatggataatggaggaggtaaaggttgaattatattttcccccatattattgacccatagtgacaccagttttgggagatgtctttcattttcgcccttacgttgttattggcaccttttgcaaaaatcaattatttatcatgagtatacttctgaaatgatctgtttcatcaatctatttgtcttctcagtagttccacattgtcttaattatagctttagaggaagtcttgaaatttggtagtaagtcttccagttttgttattttaacaaatttctctaggctgggcatggtggctcatgcctataatcccagcactttaggagccccagacaggaggatcacttaagcgcagaagatcaagaccagcctgggaaatatagcaagaccttatctctacaaaaaaatttagaaattagctgggcatggtggcacccatctgtagtcctaactgctcaggaggctgaggtgggaggattgcttgagtccaggagttcaaggctgcagtgagttgtgatcacaccattgcagtccagccaggttgacagaatgagaccctgtctcttaaaaaaaaaaaaaaaaatcctggtgatgcttttctggattaaaaaataaaataaaataaaaattggcctcactactctagcttatttgcattttctaataaatgttcagagtcaccttgtcagttcctaccaaaaagcctgtcggtattataattgagattgcatgaagtctgtagacaaacttgaagagaattgacacttaacagcagtgacttccagtctgtaaccttagcataagttctatttgtctcctttaatttttctcagaaatacctgtagttttctgtatagagatcttgaatgtattttcttaagtttattaatagacattttcacaatatgtaa

SEQ ID NO: 6143 - DNA, 5497 bp, Homo sapiens
actggctgcttccttggtttggtgcgatcgcgtgagacagcgtcaggcgcttgatttccctgagtcccggtgcctcagctgcccagtgcccacggtaaaagtctattgcactgagctgtggcaaacagcaaatgagattaccaaagatttgaacaactgttaatttagaaaaagtgctgtcgttgtaataacaacttctaggagaccggcagcccttttcagcccgttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttgaggtcaggagttcaagaccagcctggccagcatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgaggtgggtggatcactttaggtcaggatttcgagactagctaggccactagctagcctaacctggtggcacgtgcctgtaattccagctactcaggagggctgcctcatattgaacccgggaggcagaggctgcagtgagccgagaacacactactgcactacagcctgggcgaaagagtgagactcttgtctcaaaaaaaataaaaaagtgccatcaagttagaagttttaaattcatggtacaagcattgccatagatgtgcctgcaagaaacacacagatgacttttttttgagacagggtctctgttgcacaagctggagtgtggtggcgcgaacatggctcactgcaaccttgagctcctgggctcaagagatccacctgcttcagattttcatttagctgggaccacaggcatgtgccaccatgaccggctaattttttttacttttcagagagaggagggggaatctcactttgttgccaggctagtctcaaactcctgggctcaagcaatccacctgcctcggtggccagagtgctaggattacaggtgtgagttgtttttttttttaaagagacagtcttacctcattctgtcacccagaatggaatgactttctaaaattgcagaaagcagaacatattccttgctgtttataatattatagtcgtatcaaagggaaagagtatttctccttaaataaaattacaaataagaaatgtatgttttactcttactcataaaaggtattgtagaatacaaaaggtttttcaaactggttttgtctttgattggcttttataatccacacttcaaagaagaaatgcatttaacttttaataacttagtcaaaaagtataatgttgccttgccttgcataacctttaactattgcaaatgatgttttgtccttcccctttgtccagtattttccaaatggtcaacagtttaaacatttaagcttgcactgagaaaccttgccacatttcagcagttttgttttgcttttggtggagagcacctgatcgcgactttacagccaatgtatttactctaaattacacttttatagatacaaggtaaagtgtagctgggtgaaggcactcaggagccataaaatgtggtcaaccacaataaattaaaatgtaagctaaacaaagtattcacacttgcatttttttaataaggaatttaagatccatagtatctttaatgcttggaagagacacaaattcaaggtgataaaaatattaattagaagacacataacatgcctcaagtatatcaacacttgactccacaaacaaggcataaccatgaaaacaacactccctttattttgggctcccaaaatcaaaagttagaactaatttatttaatcacagatatttagtatactcaataatgcactaacaatttctttaaaaaaacactaatactgtacagtatttctgtgttttagtttttcccacagctgttgaaaatttcagccttgatttgaaacatgacctgcatgacaggctataagttgtcaatagttctttttctttggaaaagtacagttgtggcatttactcactttagcagatagctaaaagggaaaaataaggaaaaatatacactggacctgcagttaagtttttgacaatgccaaggatcaaaaacagatgaaacaacatttgctgaagatgaaaaggtattgcattggtcttaatagatgttgccatctctgggtgaggatgctgactgagcctgttctgtgtcttcatcacctctatttgtttcttcttctacgacagacctccaagagacaagatccatgtagtaagccacactaggtccttttgacccttctcattcttctgtagtctcttccctgtgacttttgacaaaaatactcagttcacaatattagctgcctgcttctgatgggtaggaggtaatcaaaatactcccaccaaagcactctatggtctagacttgatacttaaaatttagttttcagcattcctcaacaaggataccttgaggtaataggagatattttggtaagtgaaaataattcctgcttggaacacagcctactgaactcaggatttaatttcttgagtattaggcagttctcaataaattgatgtatactgaggaatgattctaaagaggttagtgatatcctgtttgagaatagatttagaaaactgaaggtactctccagctctacaattctgtattaggaacaatagggaaatgagaaagtgcctctatattgcaatctaatgagtctctgggggaagactgtctacctgcgtagtagttgagaacaagacaagctcccaaacacatgaaaatcaacttgaaataacatcaaattcagcctgggcaatatcatgagaccttatatctacaaaaaattagccaggactggtggcacacgcctgtagtcccaagctacttgcgaggttgaggcaggaggatcacgagcctgagaggccaaggctgcagtgaggtgtgatcatgccactgcactccagtctgggtgacagagcaagaccctgtctcaacaaaataaaaaacatcaaattcattccatattcaggtaacagtgacatatatctactgaattatttttcttttaggaatgtctatatctatggattgtcactataaaaaaaagaaaaaaccctaaaactgagcttgacaaagggaataaaagcatactttgtttttcttggtgtccccatgttaataaatcatttcttctctttggctcaa

SEQ ID NO: 6144 - DNA, 2094 bp, Homo sapiens
gatctcgtgagaaccaactcactaaaacaagaacaggatggggaaactgcccccatgattcaattatctccacctggtccctcccaggacacatggggattatgggaactacaagtcaagatgagatttgggtggagacacagccaaacgatatcagggtgttgtgaggattcatggagcaaatggctgtgaaagcaccttgtaaagggtagagcagtgtgcggcgtgagggattattatcattgttaagacgtctacgcctcgttgctcaccctgtgtgatcctgcagcttctcaacttttccctcctttctccctggtttccacgcctgggctgctgagtcaggcggaccggccaaggctggcgagggctgaacagatgctctgacatgtcaaggcaggaaatgacagttcccaggcagccctctgtttcaggtgtggaacaggctccgaacacactttgtgtgataaattgtagtaacgccaggctgagctctacctccacccccttaggctgcaagactaggacatgaggctgaaagtcagagaagtccctgtgagacgagggccctgagcaagcactggccagactgtagcaaggccactcaccaggccaccccgctggttctacttccgcacccacctctggcagccatgatgcttctgcagcatgccagtttgttcactgagaccttcacagaaggtcgcacaaccaccctggacggtgagaaactaaggtgactgaggcaagtcattgaaccaccctgagccttggcttcctcatctatgaaatggagttgacagcatctgtcctgcctgtggtaaaaattgctgtgatcccacaaccaaaaggaaagagagaattatgagaaaaatatgtacttattctgtgaaaatatgtgagattttcatgagagacttcctgttccagtggactcttccaccgcccttgagtggggaacatccaggccttcacactcacgctcagcccatcacccctctgtgcaaggtgcaaggtcctctgcccacctgaagcctcaaggcctgatggaaaccatccacagccactctagtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtcca

SEQ ID NO: 6145 - DNA, 1639 bp, Homo sapiens
catgcagcagaagtggaccaagcccgcgagggctggatccgaggtggagtggacagaagacctggcactgtaaggagtaaccctgccccgaccccatgctccagagcagagaggatcaaacctttccagcacagtccttgcaggaatcagctctgttttcagtagcctttggcgtgagctcctattgtatgccaggccctggcgtgggtcttagggatacagacttgaccaagatacagcccccacccctgggtcaatgacaagcttgaggcagagacaggtgtacataaagaagatggtaaaaccgctccagttgaggtttatgtaatgtgccgtcagagtgcctaggtgggggggagattaattcccatgagggaataaggatcagagtaggcttcatggaggagatgacatttaaaccacactttagagcaagagtaggatttcatcagagtgtgaaagtattctcggcagagggaagagctggagcaaatgaaagagggtggcttgcaactgagagactggcaagacaggaagagcaggaccagggaggatttgaatgcatagctgagaagcatggtttccactcaggccctgtccctttctcttgggacgagagagaatttggaggccaggagaatctgattggagcatttatgccgttttatttatgtacacagctctctgcctctggcctgtgatccactcaagtgtgggttcagcttgctaattttctccttcctgccccatctcctcttgtcccacagggatctgggcccccagagccgggagctgaccctcaaagtgctgaggagcagcagctgtggagacagtaagtgaggggtgggaggggcacccctgggtgggtacagagtggggtctggccatgggcccagctcacagtgccatccctttccccagccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattaggtaaagagaaggagcctgggagcccagctctagccaggggcccgggactgcagacccaaggcaggacagtgaaagaggagagagccttaattccaactccccctgttttcagacattccattccagtcctaccacatcttcctcccaatctttgtctcttccaaactttcccttacctcctgccatttccccagcaattcctctcactctgccacccttctggatcctcctgcccctcctcatacaggactgttgcactcctaccttccagcttcccctctggcttttcacaggtgtccttagccccagctgactataattgtccatcctgctaccctcagccctccagcaccccctggggtcctccaacaaacccagaggcctctgtggcatttctaccccactcagtgggccc

SEQ ID NO: 6146 - DNA, 3239 bp, Homo sapiens
actttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctagagagcatatttgtgtggatgggggtgggtaaacactcaacaaaagtttctttaaaaagaagaaaccatcctggtttgatgtaatcaatggttgcccactgctcccttcctgtgcctgtgacccttcccaaactgccctgttgcttgcaggctcgcctgagctgaaaggcagccctcacatcccgtcggcacctccctggggccttctttacaccctggagaacttcacagggaatctgtgtctgtaacacaaaggcttcctggtccagatgtagatactaaggctgactggttatttaagtcctgcggacttactctgccaaaattatttaatcatgtaaaaataatttataattcttataaagtatccccttcataatataatgaatgttggtgctattacatttaagtgcacatgtacagtatacaagattattaataataatgttttcaaatagttattgtcaaagctatttttcttatgtttatgaaagtgcttataaaattcatgttttatgaggctggagatgtatattttgtaatttcattctgatatttgttaatattcgcttccaatgctggttttgtttgatgagactgacattgcctaatttcaagctttttgaatgtgtattctttcagggcaagtatgaaataactagtaaaaaatatacaaatatgcttaacaataagtagactttctcacattgattacttacaacagctttatgtggggtgaatcagatgcctgtattacagaagcatctaatgcaaagcaaaataaaaacacttgcatgagcgcacagaggtaggtgtggaagaaagtgaaacactattttaggttttagttacactctgctgtggtgtgctgcctagtatttgcaggttaatgcaaatactaggggttatgaattgtttctaagtttattattaaaaatagccttgcttcatttcttcctaaaatggagacaaatatgtatagtgtctgtgttaccagtatgtgtaagagtaatatcttaatgcgtgtaaaatgtttataggaacctgtatttcaaagagctatttttgcaagtgacactatccttttaagaaacttttttattcaaactttttcctccatttataactattctattatttcttaatgttcagaacccttttcattatctataaggttaaattttaggtaagtaatgagaaaataataatatgtggagaagaaatgagtgaggagtcgagatgtgtgtcaatcaagaatgagtttgtcagcccttgtattatgattttactcgggaggggataattattgaaggatgtaatgtaagggcagtgatactatatggtatgtaagactgttaaaatcactgaggtaagctattacttgaactaagcatagaaatagagacagatttttaatgcatttaattatcaaaatatctaaattaaagatttgatgtggttgttcactggaaacaaatggcagacaaacagaatatttcttggaatcataaatgacatcatcctgtctccaactttctgtgtagcttctttctttagttggtctttgcttagatttccctgtgtcagagacgacttccctggatatcagtgacagttattgattgctcatgctatgaactcctcccatttctcagccctcttgcagtaggtggggccatggtactagttgtggcttattgcttaaagactttaaggctccatgtgtgactttccagctctggtccactgctactgcggctctggcaggactagggaggtgccccgtgtctcagatggtgcagcctccatccagctgtgtccctgaatgactagagcacagccactggtgacctgtggtggacgtagaatgtgggtaagagataaacttatgctacaccgctggggttcaggggctaatttgttaccacagcatagtcaaccttttctagcaccccattctgtctaaatttagtagtcctaccccactccatgcctccccaacccttcccctggctttagtttctttgtagcactggtccccgcatgacctgtcgttgctttactttctcgcatcacttctccctgcctccagcacatgcactaaaatttaaactccatgcctggacaaaatcaatgtttgttaaataaagtctgccagttctgtttgcgatttttcagaaacaaggaaagaaatcctatataaagttgatctgtgctttggcaatattcatttagggtaattgcccttttttcaaatggctgtgcattttttatgatgatgaatataaagtatttagcagaaatattttttattaaaattgttgagcttatggaatcaatgtagcagcctatgtgaaagaaacactgtgctagagagttgtctttctgccacgtgtaatcattacatttaactcaagttctccatgggagatccatgcagagatatgaaaataggacggacgtctcttccttcttaaaagttgctccagattttggcttcaagtgcttcctgttttttgccctcccttatccctgggagttccctctatttactttcacaaggactcttggtataaaagatatttgtatacctgggtgtgtgggaaggaattgaaggcaaaggtagcagtcatttcaagctgaacatgttaagtggtaatcgagcacttggtttttgtagtacctcctgtggccatctccacagtgtcatatttgaaagaaatcttgtgtaagcattggtctaagggtcactgactgtgaataatgaatgcggtgacagcatggccatcttagagacaggcaggccagatattggttactttgattttagttgacaaagtttatttgcttttaagttttaaagcaatacagcagtgtgaacttcaagttgtaaactttcatttagaaagtttaaaatttagttgaaatataaaatattctgaatctgaataaaaagttttaaaactt

SEQ ID NO: 6147 - DNA, 933 bp, Homo sapiens
tcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagacggagtttcactcttgttgcccagactggagtgcagtggcgtgatctcggctcatggcaacctccacctcctgggttcaagcaattctcctcagcctcctgagtagccgggattataggtgccgccaccacgcccagctaatttttgtatttttagtagagatggggtttcaccatgttagccaggctgatctcgaactcctaatgtcagtcccttttctagctcctccggtcatgatacatccacactccagactctgtgtctggccctgcatggaagccaacatggccagatggcctggattgagtcccagctggctccatcacatgctggttgtgtgaccttgggcaagcttctctctgcctcagcttcctcatctgaaaaatgggggtgatgataatagaaccccgcctcacagaatcatggttgatctgcagtccctttgacggcaggaattgtactgtttcgtctttgggtttgtaccaccaagcttggcctggtacctggtcggtgctcactctccactccttcattgggacggaagtgctggtccccgcctgccctctggtggacagtctgtgaaacaggccttcagttgggcggcgtgcaggttaccacaggggaggaagctaccagagattcactgactgctataagtgcttctaccagttgcagcctgcgatgacacagcaaatctatgacaagtttatagctcagttgcagacatctatccgggaggaaatctctgacatcaaagagg

SEQ ID NO: 6148 - DNA, 3175 bp, Homo sapiens
cgggagcggggcctgcccggactgcgacgccgccacagcttggggccagttcgcccagtcagggggatggctcggtcggcctcgggggtcgacgatcccccgggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtct

SEQ ID NO: 6149 - DNA, 1391 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacggcattggcagttctgtttggaactatctcttagagctttgtgtctgcttaaagctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 6150 - DNA, 632 bp, Homo sapiens
gacatgggatgttcgtttatttgggcaaatgtgtctcgttagggtcattctgaaaagaagcccagtgtgcagtcattagcccctggggtagcgttgctactaagtggttggggagaagtcagggaagaggaagaggtggcgttccccagcctcacccgtggagaccccagcgaagcgggggcagggagggatgatgaaccctcatcctttacctccttctccaaccctccactagcgctgctttcctggtcaaacctgcatcttcactgggtcatgccccaaggcctctgagggacttccacagtggtaaggagggctgccctttttatttttttttggttgtggctgagaatgctggagatgctcagttctctccctcacaaggtaggccacaaattcttggtggtgccctcacatctggggtcttcaggcaccagccatgcctgccgaggagtgctgtcaggacagaccatgtccgtgctaggcccaggcacagcccaaccactcctcatccaagtctctcccaggtttctggtcccgatgggcaaggatgacccctccagtggctggtaccccaccatcccactacccctcacatgctctcactctccatcaggtccccaatcctggct

SEQ ID NO: 6151 - DNA, 1376 bp, Homo sapiens
cgggaacttcctcccctgcagagaccacctcgctcccgggactcgccagcgagggatgccgccggccgccgggggccttctccaggaccaggagagaaatcctctctccgcttcacgacgcggccactcccacccctgagacgcccacctggcggactctgagggaggattcggctgcgtctaataccacctccacccctcatccctcacaatgcgcggaaaaccacaggcggctgtgcgcgcagcgtcggctcagccaccgcagctcctcccctgggatgaaaaagcactctgacgtcttgaaagctggcagctctctgtttggaaaatctctgcccagtgaaaaaatgtaccgacaagattactaagtaacacagtcttctgggaatgccttatcaatgccagctatttgaagagcacccaaagtcaaactagtgctccgcgctggcagtctggaaaaggcagatgtataaaccaaaaaggatggagttcagagaccttccatgttgatgaacaagaacacattcacctgctgtaggggtaggtgtaccccaaaactccactgatacagaagcttctatactcaagacccttctatactcaagaccctggatcttaccctatatatctcttcatctggctatttatttgcatcttttaatatatcctttgtaataaactagtaatctagaaagcaaacttttcctagctctgtaggccattctagtaaatgattaaacctgaggaggagttatgggaacctttgatttgtagacaagttggacaaaagtggtatatatcctaatataacatgggaacctgccacttatgattggcgtgtgaaattgggggatggggaagcagtcttgtgggactgagcccttagcctgtggggtctaatgctatcttcaggtaatatcagaactgagttaaattataggataccagtcagtgtccattggagaactgaattattgtgaggagaaacccacacatttggtggctaaaagtattgatgtgagtagtagcatataggagttttttgctatatacatatgtagtgtaagtttaaagtaaaaagttttgtattgtcaggagtgacttctttgcacctaaatatcactgctataactgcgttactaaggaatagttgcttgcttttatgtatttggcacctgcagctactgttctaaaaagtttgcatgtgttaacctattaattaaatctacaaatgactggctgtacccatgaagtgagttattctaaagacaatggaacatttaaatggtttagaaattttttgattaaaaatacattaataatatctcctaaagaatgtgactgatttttttccagggctcaaatttttcagtctt

SEQ ID NO: 6152 - DNA, 401 bp, Homo sapiens
ttagacccagaccagtgccaaaggctcaatggcagaatagaatcaaagatgggagaattgtctctagtttttgtttaatctgtagtttttctttcctaggattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacagtaagtatgtttcttaatttaccctgcctcatgggccagaaagcaaacacgattatgtactcagcagtaaaaattggcgcaaatatatttatgcatttgggtcagatcattttagatattcctttaccaaa

SEQ ID NO: 6153 - DNA, 3072 bp, Homo sapiens
gctgctgctgttgctgctgcgacgccgaggacgagccggcggtcaggccgtccagcaccttcctgatgttgaatttcctcatggtctcggaggggctcccccgcagcccgggaggggaggcacagggggtccccgggcgggggagaccacccggggccgaaggcagcttcgaccgcggaaacggaggagtgggagtgtgaggagaaatatgcaatgatgacatttccaagaagtgatggcatctggcgctaaggacaaagaatgggattttgccacagggatcttattctcccacatgttctgtctgaaggagaaagttatctgaggccttatatgatgcaaaactttggactcaaagaaattaaatcacttgcccaaggttacatagctgcccctggcaaacaccattctactttccgtctctatgaatttgactactcgaagtacctcatgtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgaggtggtgaccagatggatataaacgggctgtggaaaaagagaatgcatggccaaaaatggtggtgctctctgtccaaaaactgaggccctatgaccatgaatgaagccagagggcaggtaggaatagatcatttgctccagaagaagctggttgccatgtcttgaggacagtaaaccctctggggaggttcctgtggtaaggaacaagggctcctggcaatagcctctgagtgagccaccttgaaaatggattgtccagccccagtcaagctttcagatgactgtagctcctgccaatgtcttcaccacaacctcatgagatcccaagctacaaccactcagttaagttatgccaaaattcctgattcacagaaattgacatacaggagaggtcacagttaagatcttgatgttctatcttgacccataatataggaacttcatcttttgggaagcaccagggagagctgcctgtgcctggcagaagctgcccatgccccactgataccccacagtacttcctgttctgcttagtactcctgcttctttctacaaacaactgtgattctctacctgggagcttcctctggccacaggagcctgctcacctgattgggacaccctagcagtactggctcatagatggaagggacttgccttgtcgctgatgagactttcgacttggacttttgagtcaatgctggaatgagttaagactttggggaactgttggaagggtgtgattgtgttttgaattgtgaggacatgagattttgaagaggctaatggcagcgtccccacctaaatctcttcttgaattgtagttcccataatccccacgtgtcgtggggtggagccggtggagataattgaatcatgggaacactttcccccatgctgttattgtgattgtgaattctcacgagatctgatggttgtataaacgccttccctcttcgctgggcactcatttttctccttcctgccaccatgtgaagaaggatatgcttgcttcttgtgccatgattacaagaacacactcagaaattttctcaacacagtttctatgcagagaagagatgtgggacagatttgaactgctgtcatatttgtatgaacccaagacattttccaagaccaagagggataaagacagcaatttctatgactggcattttacgtgcatgcactgtttccaagtgttcttgtgttctgtgccttaaacattctgtgttgcaactttatgaattgaattaaagataatcccaagcccccaattgtctcaaaaagtgaaaaagtaaatgttatagaaagaaaagcgggaaaaactttaagcatgaaataaaagatgggttgtgataaaagaggactgaagaaggaaaaggaatgaaaggttctgccatccttcatggcagcccactccacttggtatgagatactgctcccttggctgaaagttaactgctgtactccctccactttctataaatgactccctgtgcctttccttcaccacacaactcacactctcttccttcctagtgagtccactaaggcttcactgcattattacatttatttcatttaggaaaaactgactttattttccttcaaattgttttttattgtttatatgagcttggttttattgtcattctatttttctccatgaaaatagagaaaaatagggtcgaaaggttaggttgggtggaaaggaattatattttttctcactaaaattgatgtaaatatcgttttcaattgaatgattttacacagtggcacagtttcaggtatgttgctaagcaggaaagttgttaaccaaagcatgaatgtattaaggagatgtatgcagaatgacatgcaaggttatctatgattgctgagtgagaaagagcaagttgctgagtattatataagtatgatctcacttttgtaaaaaaaaaaaaaaaaaaaggcctggactgatctgaaatgaccctattaataacaattatgtccaggtctgtattgcatacttgtcattcattacaggatcttgagacacaatgcaaaggatcacatcgcagctctgtaacttgttaactataagattttgagtaacataacaccttactccttaaaattgcttaaaaaaaatctgaacatcaggaatattctacttcacagggtcgttgtgataattaaatgtagtaatcaatgacaatagtgccagatacagtagatagcctacactttgcagctactatttctatctatcatccatctattaatatatatcatctatctttaacttatcatctatcttgttccagttttttaaaatgaacatgtattaactttgtaaaaaattaaggctataagatgtgctgagcttttggaatagattttcctgtactatatatgactgccagtgggagaatttgaataaatgtgtaaatttgactaa

SEQ ID NO: 6154 - DNA, 2792 bp, Homo sapiens
gggaaggctttaaaaagcagatatggaccagggtagagttcgtacgctgtagcttttcaagaacaccgatctcattaattaaagaacagcaactatttaattccagttataaactattgttttccagttagtctgggtaggtgtggccgtttgtagaatagttagattacattagtctattgcgttggtacagttgtctatagcttgagcatataaaaactcctgagcccagcagaaaagttactttccaataccagtctccatcctccgtgctttggaagttgcatcgttttccggtttttcgtactcaaagaacactgtcaattatgacagctctgtgacctctggtaatgaattagtgtattagtcactcctgaaacgttccttaaagtgctggaacttaacagtagcacagcacatccagtacacagctgtaccgtatttccatatttttcaaagctgaaaatcttaattggatatcttggatcattaacttaaaacctcagcggatttttctttcaaagcagacataactgaggatgctgaccaatgaatgcaaataaactatgcaatattttttaaaataacaaatgtatgttagttttttttaagctgaggtcaactatgttttggggggtatgtgcttttttaaattattgttttatttcaatcgatttttgggggtaacaggtggcgtttggttacatgaataaggtttttagtggtgatttctgagattttggtgcgtccgagcaatgtacactgtatccaatgtgtagtcttttgtccctcattagccttccccttacccctgagctcccgagtccccaaagtccaatgtatcattcttattgaagacagctaaatttttaactctgagactcactggagagaatgactggttgtctttgggtgttactgaaaagccaaaggattaagcaatagggataaagtagaggaggagataattgttctcgtatgtcatatgaaaatgctaaccatagtttgtaagctaacagaagaagcctgaggaagttcccgaatttatgatatcctcttcccttttttccaaagaaagatgcagtctagcacctcagttaagaatatggactctaaagtcagactgccaggcttcaaattccagttctgcgacctcagcaaagttacttaaccaagctctcagtgccttgttttcttcatctgtaaaatgaggatgacgtcacagcattgttgagagaattaatacaggctccagacttgtgaatggagaagtgttgaggtgaccccagctccagccaccagctgacgacaaccataccggagatcctgagagctgcctagctgaccccaggcaccccccagacttattcagcacttagaagaatgccaggcaggctttccccaccaaccaagatggaataacagggaaaagacatacccttctatcttcaataattggaaacccagacaaagtttatgaaacgctggttttcaagacataggacatcagacaatcaaggacagtaaacactgagatgggaaacaaacaaggtgagtactgcaattgcccaacattactagctggaaagagtttcccgaccatggcagagggaggaggatcctttgaggttctgtggtgtccctgagttgaggagacaaagttgaaattccagagtggtcaaggcagctggagtttgtagagcagagtaccagaaagaaaatagatgcacagagagaacctcagagatctgcaaaagatctcagctcttcagctgtgcacctatcagtacatgcatgtgacaaagcaccccaaggccaggggaagaatcacctgaaagtatgaagagaagaatacttggagcatatacaaaccaggaataatttcagttctcaccagccaaattggaagaccccatagataacaggcattaggtagagcaggggtccccaacctccaggggcactgaccagtactgttcatggcctgttaggaactgggctgcacagcaggaggtgagcggcaggctagccagcaaaccttcatctgtatttatagctcccatcacttgcattactccccatcactccccatcacttgcattaccacctgagctccacctcctctcagatcagcagcagcattagattctcataggagtgtgaaccctactgtgaactgcacatgcaagggatctaggttgtgcactgtttatgagaatctaatgcctgatgatctgaggtgcagctgaggcagcatagctaggaggtaggtattttgttgctggggactcatatcaaaaccctatcagtgagtggcaagtgacaattaagctgcatctggtggcagactttatagaggcaagtgagtcaatgtatttcaattgcacagctctatctggtggcaagttttaagtcagaatctgacacttaatttagtctgtgcatggcctgcccattattttatttaccacttctgtctgtgcctctttgctgcactgaacacttgtctcagtcacagttttggtaagcccacaagctaaccctagctaaaatgagtaaaaagcaaacgacactggagagcttctttgaaaagtcagagagacccaatgatgagacagcagaagactcttaagactgccaacaaaaagaaagctgcacttaaaagaaaataccagactgggcgtggtggctcacacctgtaatcctagcactttgggaggctgaagcaggtggatcccttgaggccaggagtttgagaccagccaagccaacatggtgaaacccatgtttct

SEQ ID NO: 6155 - DNA, 2405 bp, Homo sapiens
caacgcttttgacaagtcaaacttttctaaacatcaagaaaatcatgctgctgagaaatcctagaaatgtgaagaatgtgacaaagcctctaaatgattgtcacacttgatcgtagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttaggtgctaggcccagcaatacatctcaagcacttcttgggcaaagcccaagcagtaaaaaagagtcacattacctaggttctgggtatagcaatatgtcacaaatgcccctaagaagagggcccaggaaaagagagtcaccttggtgagaatgtcagagatattccatttttgggtattcacaaaaaagaataaagtcccataacctagaaggtgggctctgctccatgacacaaatcaccctagtgggcaggtccattaaagagaaggctgtcaaagcacatagatgctgggcaaagtgatatgtcataatccccatgatgataggcccagagacatgtcacaatgacctctttaggcagagaccaggcagaagaatcacatcacttgtgtgctggccctagtgataagtcactctcatttctgtggacatggcccaggcagaagagcagagtcacattacctaagcgctgggtcaagagatatgtcacaatcttttacatgggcaaaacccaggtaaaaaagaggagtaatatcagatagtaggtgttgccagagatatgtcaaaatgccccctgtatgaaagactcaggcagtcaaaacacattagttggtttcttaacctagtgatatgttataatctttcctgtgggtatgatgcaggcagaagacgagagtcatgtgatggatgcagagacatgtcacaaggtcttctgtgggcagggtccagactgaagccttccacctgctaggggttgagcccaatgatatgtcacaatacccaaattatgcagggcccaggcaaaaaaaacgagaggcacatcacctgggttctggatccaatgatatatcacaattttctattttggcaagacccaggcagaaagaaaagttacatcacctaggtgatgaatgaaaatacatattataatagttttgtgggcaggacccatgcgggagagtcacatcacctaggtgttggacccagaaatatgtcacaatatacagtgtatacagagctgaggcatgagacaatagtaacttcactcatttgttgagcccagctatacaatccttttttgggcacagccgaagtagtagaggagagttacatcaccttggtgctgggtccagcaatgtgtcaccatacctgctgaggggagggtacaggcaagagagccacatcacttaggtgaggggcccagagatatctcacagtaccccctgtgggtagaactcaggaaaaaggagagagtcacataatctagaagctgagctcagctgtatgttacaatcacccagtggacaggtcccaggcatgagagtagagtcacatcacataggtgctggaccaagcaatttgtcacaaccttcactgtggacaggtccccagaaaaagagaatcacatcatttaggtaacaaaacctgagttagtcactgttacttgtttgggcagaggtcaggaagaagtgtcacacaacatgtatgctggactaagcaatacgtcactctctctgttttaggtatggcccaggcaggagagaagggtcatatcacctaagctctggattcgcagataggccccaatctcttttttgggcaatgctcgggtaagagagcagagtcacatcaagtggttgatgggcccagagatatatcacattgccccttgtggacagggaccaggcaggggactcacatcacaatagaggtaggacaaggaatacatcacaatacgttttgagagcagaaccaaaaaagagtaacataatctttgtgttgagtgcagcaatatgttacacttttctttgtgggcagaacgtgtaaagaaggaaaaagttggccggacacggtggcctgtaatcccaacactttgggaggtcaaggtgggcagatcacctgaggtcaggagttcaagaccagcctggccaacatggcaaaacgctgtctctactaaaaatacaaaaattggctgggtgtggtggcaggcacctgtaattctagctactcaggaggctgaggcaggagagtcacctgaacctttgaggcagaggctgcagtaagcaaagatcacgccactgcactccagtgtgggtgacacagcaagactccatctc

SEQ ID NO: 6156 - DNA, 1699 bp, Homo sapiens
agttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccgggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatgtagaaattggtaaccagagaatttttcaccagaaatattataaatatccttgaatcagcaatttattatggaatttatttatcctacaacgtatccaaaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaattta

SEQ ID NO: 6157 - DNA, 382 bp, Homo sapiens
gatccaggagaaccacgacgagacctacggcgtgccctccctggaggagctgggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtaagggggacatacctgcccacattgcacctaaggcctgcagccaggccttttgggcttgtcagtcaccctaaaaaaggcactggtgggtgggggttgggctatggcccctggaagggcctaagtgtgtgcagatagtccggaggaggagagaagactcaatatccaagagggcagagccaagcaca

SEQ ID NO: 6158 - DNA, 2769 bp, Homo sapiens
cttctcgcgcgtgagcgcgccctatcggctcctggcgcgtcaacattccgcgggccaggccttggggcgcgtctgaggagggggatgtctgtggcctctccgcccacacttcctccacccaccgcccacagcgccccagaaggacctattactcgtttggcttctgaaggccgaagccaggctctggcggggatagaaccctgaagggcctgcgccagctccaacttagggccctgtgcgtcgttgcgacttctgctaccaccctatcacgcggcacccccgccccaactccgcccgggtctctgaagaggcaataggcctttcatctccggggaaagtctcaccttggccctcagacacccgccaagaggggtcggaaggacagaattagcatagagaagagtggctagagcacttttcaggctctggccccaggaatccttgacaggaagcgtggggttgctgcccagcctcccacgcagtgtaatatgttgaagccgggcccctttgagggaatgcgacttccttgggccgagggggaaagggtaaaagttaattttcataaaatgctatgcaagggctaaatgtgaaattataaaatgtcctttaagacagtcttcttgaaatcgtatcaagtttgacaagatttttggtgcacggtaacgcttttgctcgctttctacgctgtcacgtctccatcctgcaacactgaatacgtagatggaacgtggatcagctaataactgcagcaaaataaaaactgcatttatcatctttatcattatttaaatagacctccgagaagtcaaactgtgatttaggaaaacttaatcattgcctcaacctatttaactattttgttttgaagttactttgcaaatataccacaaaatccctctttgttaggcagtggtagacttttaaactcacttgttagagaatctttcccagaagcatatctagttgagcctgcgaggcaagtaggactaaggtataattactcccattttacagatgaaaatttagttatcaaaatgtaagtcagttgttcagcattgtgaggagtctatcactgataaagggaaaactctaaggtctattattgcctgctttattcactaaaccagaaatctctcaattgtttttttccaagtatcttttgctgcctcttacgtattgtaggcagtgcctgatggctgagaagaatcgcagaggactagaaaaggtttgagtctgaaattatctggcacagaggattaaagctcagaaataagtgattgcgaaacagttcaacttccctgttaatgacaacaacaacagcaacacgcttattaattcctagctggagcatcaagcttatgaagatttccaagactttattgttgacccttgttgaagagaactctacttggcttctttcctggctttcctaaattgttcacatacaagataaactaccgtcattcagacttacagaagtgagaagacaagctgaaccaaatgtaaaatggtagcaatttacagatgtcagaactaacatgtggatgaacttagagatggagaagaaagctgggcttttccaaagagtggatctatctgaactggatagcactattgaactttgttgcatattttgtggtagctctaaaactcctctgcttgcttacatacaaccagacaccagtgccttctgaagctaatccaggccatttttataacctaatgcagtagcactttgcaattagatgaagaagatcggtgggatttctttctgtggtgattaaaatgtgtcaggggaagaaatcaagacaatactccaagtgaaaaatataaagtcagttatttctttaatattttgtgttatagtaatcatttttatattttgagcatactttttcttgtctacttaaatactcaaaattaattataaaatgtaaatgtaagcacaatgagataccatctcatcccagttaaaatggcttttatcaaaaagatagggaataatgaatactggtggaaggatgtggagaatggggaaccctcgtacactgtcaatgagaatgtaaattagtacagccactatggaaaactgtatggaagtgcctccgaaaacaaagtagaactaccatgtgatccagcaattacactagtgggtatatattcaaaagaaaggaaatcaacatattaaagagatagctgcattctcatgtttattgaagtcctgttgaaatagccaaaatatggaatcaacctaagtgcccatcagtggatgaatggttaaagaaaatgtgattgatatgcaatggaatattattcagccataaaaaagaatgaaatcctggcggggcacagtggctcatgcaagtaatcccagcactgacctcatgaagacagagagtagattggtggttaccagaggttgagaaggggagaggagaggagggatgaagagaggttgattgatggatagaaatatacagtttgataatgataaatcagtagggtgactatagtttataataacctattgtatggttcaaaatagctaaaagagaataattgaaataacgtaagacaaaaatttaagatgatagatatcccaattacactgatttgatctttacaaattatatgaatgtattaaattattacatgtatccccaaaatatgtacaagtattttgtatcaataaaaaataaaatttaagataaagtaaatgtaatgattagcttatatttcctagatcggaaataaatatttacttaagta

SEQ ID NO: 6159 - DNA, 710 bp, Homo sapiens
cgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtaagtatgtgtacatgaatgtgtccactcttggctataccaaagtgatagcctttgaactgatgggaaaaagtgaccctacaaagtatctttatccttttgcatgtattcttttctgcttctagtataagcccagtgcagtccttgttatgtaaatttgatattagtaataaaatttaatcaggtttttaaagaaacagcacctagaaaacctagtaatttcaaagtgtcagagttagcgtggtatcc

SEQ ID NO: 6160 - DNA, 213 bp, Homo sapiens
aatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacggtcctaatgccccgagccaagttccactggttcttcttgaagatgtatcgaatgtgtatggtg

SEQ ID NO: 6161 - DNA, 562 bp, Homo sapiens
agttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgaggtaagaccaagtttgcaaaattacattctttcacaaatatttgttgactgcctgctatgtataggatagaagtgtgtaagaaataggtagttctaacccttagtaatactgcactgtacttatgatagaatgtcttatagttaaaagtacttcaaatttcatgtttttggagtacattttaacttatataaatgactgttgaatttagatttattgttttttttcccctgatggaataattaatattcaggaagcttgattactgaaatcaagtacttctgtga

SEQ ID NO: 6162 - DNA, 765 bp, Homo sapiens
aacggttttctctctcgtcgaccaacctcgggtatttccgactcccttcgggcttttccgtctggttcccgctcggctttctccacttcgggtattcccgtgtcccgctcggaagcactcggcaatcgctcggcctcccccatcccccggtaacggtcgctggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaatt

SEQ ID NO: 6163 - DNA, 2038 bp, Homo sapiens
gcgcagccccagcccatcccgtgcggaccctacgccgagtccagcccggggctgctgggccagcgggagcgggaaccggacggcgctcgcgttctgccagagcggagaacgactcggggacggtgcggaggaccaggggaggagatccgcgcccgcacgcaccatcagccgagaggacggcccgcatcgcgccagtgacctaggagcgactcggggacggcttcgggctcccaggccctcctgggccaccgggcactgaggagagcggcggctggaaactgtgggacccgaagggcgggagcccagggcccgcccccgccggagcgcccccgccatggccacgcccccgccacggggatgggcagggcaagcaccggaagtgcgtcacgcgggagcgtctgcgtcgcctaccctgcgtggcgcagctaggttccgagcggcttagcctccgggcgcctgcgcagtggcggtcctagagacgcactcggttgccatagagacgggggcttgggagcgacgtcgcgctcgctggcactggcggcacttgccgcgccgcagccacctctttccgactccaccagtgcgggccctatccggggttttgagtcacgcagacctggacacagcgagaaacggcagtccgggcccgtcctcccgccccgggttctgcaccccagagttggacgcttgcttctcgctttctcctgagagaagtctccgcgtttctgaacaatgcactgctagtttctcatttctttctttctttctttttttttttttggagacggagcctcgccctgtcgcccaggctggagtgcaatggcgcgatctcggctcattgcaacctccgcctccagggcttaaactattctcttgcttcagcctcccgagcagctgggactacaggcatgcgctaccacgcacagctaatttttgcatttttagtcaagacggggtttcaccattttggccaggctgatttcgaactcctgacctcgtgatctgccctcctagggctcccaacgtgctgggattataggcgtgagccaccgcgcccggcctctcatttcttaattgtagacattgcgtacttccggagaaggtccctgagaacctggctgatcttccccgctgcacccctcacgtggtcctgttagctcccaaactgtcaacctgaaaggaaacccagaggcaggctctccaggacaagtgagttaatctgggaatcgcagggggttgcagcctaggctgttcgtgccatgacagatcataggcctatctgagagggccgggcgaaggggaaaatacagatgagctcacaaaagttgttttgtaacaaaaaccactggctgtgggcgcttgctgcaggagtgggcgttagcttgttgttggagagagccttaccaggccgacgtccttgtgcaagctgcttatctagaatactgcagtcctgaggaatttccctgcagtaagtccggttacaggcaaacgtgcaggacgtgcaggagcgtcttgtgaggaggcctgctgcaggtattcctgcatgagagctcccccttcgtggcctcccgactccatttgtttagggattggtggaagtagttccattttggtacctgcaactttcacagctgtcgtgatgaaatcaggcttagctcttcatgattgagtacctgctgttcactgctacagtataaaaccatgccacaattcctgtacaatctttttttttcttttgagttaataattacctaatattttcacatatctagctttttactaacccatggccagcctttttttcaagtaccccaacgttttcgccacatgcctaacgataccgttttccaaaggctcaaacacatccgttgtgtctaactgattctcctgttccgacctagaccgatcacttcctgacccggctgcacagctcttatctcgagcttttctctgctctcatccttgagactcactttgtctgtctcctttcttggattccctgtgtaaacgaaaaataaaatcctaagctctctaccaa

SEQ ID NO: 6164 - DNA, 557 bp, Homo sapiens
aatctgtcttataagattactgagaaagtaatgaacactgtcaccttggttgtcatgtggtgaactgcatgtattggttaataataatcatacattttcagtcttgatttgacaaaagcaacaaagtatcttttctctcaatataggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaac

SEQ ID NO: 6165 - DNA, 562 bp, Homo sapiens
accaaatgattacgtacctagcccaacccgtaatatggctccctcgcagcagagccctgtgaggacagcttctgtgaatcaaagaaatcgaacttacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagct

SEQ ID NO: 6166 - DNA, 768 bp, Homo sapiens
ccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcag

SEQ ID NO: 6167 - DNA, 590 bp, Homo sapiens
cttttcagtcgggcgctgagtggtttttcggatcatgtctggtggctccgcggattataacagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggag

SEQ ID NO: 6168 - DNA, 1573 bp, Homo sapiens
catctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcc

SEQ ID NO: 6169 - DNA, 3352 bp, Homo sapiens
agatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccaggtccttgacaggcgtgcatctgggccagatccatggcaataaccttcaggttgaggctagagggcttcagatgggcagcttcgaatgacaggagcaaggcacaagaggccggaaagggagggtgacattttcagcatctataagatcaactttagaaacatttgggggttgacaaattcccatcaagctctgtggatcttgtacaactgctcaccaccggcttctcatcagcacatgattggtgcagggttctgaggatgattttgagatgttccctgatgtggtcttgtgaggagatttcatgacagatggcaggaagcttcgtggagagatttctgaagacactcctgagctcccaacaccgggcaactctcttccagaggatagtggggtggagggtagaagagaggcaaagtcaggagaagggaaaatgttacattgtcaaagtcccaaagcctttcagcctgaagccaggaacaattgttcaaagtttctttggaacatcaaggaaggaaatccagattttactttaagtgcaatggggagtcattaaggattttgtgtagatacagcaaaaagacaacaatcttcaagccacaatggccctcaccagaacccagccatgtggtcagcctgatctcggacttcacagccagcagaactgtttgtcaaagatcagatggtttccttaagctgataagcaacttcaacaaagtctcaggatacaaaatcaatgtgcaaaaatcataagcattcttatacaccaataacagacaaacagccaaatcatgagtgaacttccattcataattgcacaaagagaatcaaatacctaggaatccagcttacaagggatgtgaaggacctcttcaaggagaactacaaaccactgctcaatgaaataaaaggggacacaaacaaatggaagaacattccatgctcatggttaggaagaatcaatatcgtgaaaatggccatactgcccaagataatttatagattcaatgccatccccatcaagctaccaatgactttcttcacagaattggaagaaactacgttaaagttcatatggaaccagaaaagagcctgcactgccaagacaaccctaagcaaaaagaacaaagctggaggcatcatgccacctgacttcaaactatactacaaggctacagtaaccaaagcagcatggtactggtaccaaaacagagatatagaccaacggaacagaacagaggcctcagaaataacaccacgcatctacagtctatggtattttactatggaagcccaccctaagatttcaatttagcttccatgtagttccctggtgcttggcaatctcctgactcactaccttgtcacatggtctatcccaagtcagtccttctcctcttcccatatccccctactccaatattcacccatatgtggccaagtcttcctccacctgagctccttgcagaggaatgaacaattgtttgaacattaatgaatattaaagttatctgatcatttcaaattgggaccacttaggaactttttctgtgttgtttctttaactttcatgtccagtgattgagttcttctccagagctgttgagacctaaataaatccagcctatcatctttcttctcatgctgcttttgttatacacagacagcatgagtgtcacatgagaaagctgaaatagggtcactttgaaaacaaaagtttccttgtatactggatttggccgccctctgcggatggatatcttgcatttggacatctcttgatccgtggatttccgtagagttaacttaacatatgtattgggtggtctgtttgctgcccaattttttaagtggctgccttttatcacttctgctgatagtctcccatttgtggcattataaagcaggctaatgagaatttctggaactgacccgtcttcgagagactgacatgcggatgtactttcactacaagacatttctgacacgctcatttgggagtcacagacacattttatcttgtgaattgttccttgtactgtattctgaaccaagatctggaagccctccaacattttcaaaacagaactgcttattaatatagagaaaaagaagcagcatcaggataataaacacccaaacagctgacaaaaacccaactgcctctggagatacttttctaaaacaggaaagcttcctgctgactcaaaaggatttttcttcttctgaactcctattatgggaatggatgaaatcacttacagagccacagaaggaaacaaagcaaagccaggatcatgagttggattatctggaggcctaggccaatggggagttattgcttgcagtcactgatcaagcaaataaacttttccttctttcttatgaaatttatttaagaagctgaaattacttaaatgataatgagttgtgagaaaagaattgtagtagatatttgttctctatccaaattgcactgagtggggaggtgtacccataccccagcttcgagaattgactgataacagttcacacctgcacttctccagagaattgtccttgtctgacctgagcaccttgtttagtaatgtctggtaggctatgctccaccttccctgggcagatccactggtctaagacaaacaacccaaccctctaatttctgggaagaatcacctccgtgattaatctaagctccagatctcccagagaaatcatgctgaggctacatttgtgaaactacatttttatctagcttcttcctttgccctttcctgctgtcctcacttccttatgaatttttttctgaaagatcttgattaataaattatttaatcaagatcccccagtcataagttctgtgttttggaatataacctatacaaaaataaattaattggtactagataatgctccgctatgcatctatttcaatgtctattctttggaagttctgtcatcacacatccccaagttttagataaggtttttagctaacagccaggaaaagattcaataaa

SEQ ID NO: 6170 - DNA, 1405 bp, Homo sapiens
ggggcggagggaggggcggaaagagcagagggaggggcacagggggctgaggagtgctgggtcgggcttccagctccctacaacgcagaccagtactggagttcgtggtgctggaagaccgccgcccgactctgggccccgggtaggaaacaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaa

SEQ ID NO: 6171 - DNA, 745 bp, Homo sapiens
gggaaaacagggcgcattttctaacatgtcagcacccccagaccacccaggcccccgtcagaaaaatactggctccatgatcagctttgaaacaactttattagaaggctgctttaaatgacaacttctaacgtccaattctttcttaatttgctttttgacgactccagttatatgttcatatataacaatttttgcattgatctttgcatcctattgaagatttcctcatcaggtcattctggtggaatggaagtgcaaccgtgaggtcgccagttggccggcattgttaagcaagggcagcagaaggctgggagggacggagccagtcccccaccctctcctccagcccccgcccaccacaaattcacagtgagaggcacctcactgccttgacattcagaaaagagtgaaataaagaaaccctcgcagcgcaggaaataactggattccaccttcaaggttattgaggttcctccctctctctccacgcccccagtcaaaccctgaaatcctaaggctgggggcaagcccttccccaacctgccaaaggaaaggagccagggctgctgccttctggccgcttttctgcctccagtcccaaaaggaatttctctggacagatgtgactgcagcggcccaaggccccccttctcctcctcctcccatcccactgggcgggcttgggaaggtacaatcaaccatgaacataaatatgaataaaaaatgaacttgaaaatgacaa

SEQ ID NO: 6172 - DNA, 674 bp, Homo sapiens
tgaactgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 6173 - DNA, 906 bp, Homo sapiens
atgctgaaataaccatactagttaacatagttgtttttaaattttgcaatatcattgcatggcttcatcttttaaatttctgcaaggtttcaatatatctatttcttctttttttgataggcaaatgaataattctggaagggtaaaacatgagtctactaaatacataaatgaatacaatgtatactttaggaaagtagatttttaaacaaggacatatttttaaatttctgcttatgtttaggtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtgtttgctttctgctctgttgcttttaaattgtatgggaaaggaagattggtccgacggcgcgcttgtggcccggccggagcttgcgtgcgcgttctgacggctgggtgctgtgttacaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaactttta

SEQ ID NO: 6174 - DNA, 862 bp, Homo sapiens
cctcatttcgttctctgaatagctctaagagcgtgaacaaccccagaaggaaaaagagtgctgttgttaaaggtatctggcatcatggacccaaccatcaccaggagtttctcacttcatctctgctttattgtagtataatttgcatacaataatggcacacatttaatgtgcacagtgtgataaattttgacatatgtatacatccatgaagccggcaccacaatcaagataatgaacatctcgcttaccccagaagtttcctgtgccctgtcactcctccgtattcctccatcctcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacaga

SEQ ID NO: 6175 - DNA, 2276 bp, Homo sapiens
cgtgagggctgccgcgggtgggtggtatcgaggcctgtcgggtcagggcggttcgcgggtgctgtcagagctgggccggggcccctaggcagggtagccgggtcgtagaggcgggggccggtcgcggtcggtggagcgggatgaggatgtaggaggggcggacgtggcggaagccgcggggtccgcggggtcggtgcctctagggagccagggaggcctttcccgaggctcctggggaagaagaggcgaagcgagagtccctggggaacccccactccactcccagctggagactgggttgtgtctgcatggaccagagcccacagtgcgagttgctataggcaaccagccagggtggccagctccttcccgtttgcccgtgatgttctggttttgggaccaaagcatcctaggcctccagcccactgcagtgaccgaattctgcgccccctgcccatcttctcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaaggtaggtagactacaggaaggtacatcttgttttatattttgtcctgtagaagtcagatttcagcccagttgtgtaggagtgaggatgagcctatgcttatatcagagctttgagtacagagacatttggtctggaattttagtcagcctcttcaaccccagaatttataggttcaatcagaacagacattagcttaagttttcccatcaatcgtctatcattaaactggcaaaatctaaataattagaaaatatgacaaagatgatccagacagagatgttcaactttttccttaattcaaaaagcctcgtggtggaacatcggacccattcaagaggaaggatgaaagctctatataggaacacgatgtgaatggaagaaacctgtcattatgcaaataatacggcactccgaacagacactaaaaacagctctcatctcaaagaacccagtgcttgtatcacagtatgagaaattaaatgctggggaacaacgtttaatgaatgaagccttccagccagccagtgatctctttggacccattaccttgcattctccatcagattggatcacctcccaccctgaggctccccaagactttgaacagttcttcagtgatccttacagaaagacaccctctccaaacaaacgcagcatttatatacagtccattggtaaatactggtaatgtgctggttttggttcagttttgcagtggcgctcttgtcaggaatagtccaggctatgggtctgattcagatgggccgttttaggatcgtttttgatattcattgcggcggtacaagttttgtagccaaactgacttaaaagataacattttgtttctttttgtttcatagcaacaccaatgaatgataaaggttattgaaaatttagagttggttttgtttctaatttgaatcttcttactcatagactgggtaaacactgaataatcatcttaaagtctgtttttaaatgttcttccatattgtaggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggcactggtgaggtggattgatgatgaatcttctgacacacctggagcaactccagaacacagtcacgaggataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactc

SEQ ID NO: 6176 - DNA, 438 bp, Homo sapiens
gtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatatt

SEQ ID NO: 6177 - DNA, 4605 bp, Homo sapiens
gacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtgagagccaaggcctgttctttccacttctggggctgtgacttgagtttctccgcaggagcagatagtgtttgtgtagggactgcggacttttgcattacagcctccctgctttgcccgcctgctgctggaagcttagcaggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtgtgctcggaaatctcttccttaactgtgactttctgacaggtggaggatgtggtcaggagtgggaaaaggattcgagacgggaagagggaggggttcaggatgaagagagataatctgtgccacagatgctggccctgcagttagctcccacctagtccgtgcacacacattctaatcccctcccattcctttacatgctgcggccagagaggcctttctcaaagtggaagtctcatcctcacttctctggttacagtgctgggccatggtaacttacaaggcttagcaggaactgtctgcgcactcccccttcctgcccactaccttgtttccctccagttgcgagagaaaacattgattgagcattaactatgtgccaggcttgtcctaagtcctttgcatgtattcactcaaacaatcctcacaacattcctatcacatctcccatttcacagtgagggttctaaagcacgtagtgggtgaggaacttgtccagggtcacacaactaagtgggggtggagaaacatcaaatctaggtggtccaggtggtggccagaacccatcagcacctcactacagctgcctccagtttctcgctctaggaaatactcttccctgtcaactcctgttgtcctctgggctcagttgacatgtcatctccttgaggaggacatcctgagatgctccccgactagggtgggcacccacttccacactccaaatgcctatttgacctgtgtatcgctgcatccccactgcctggcagatagcaggcccctaataaatatgatttgagcaaataaatatagttcttcaaaaaatagggaggacttcttgcttcaggtaatggtaggctaggacatttggaccaaccctcctgcagaaaatagccatttattttgatgcaatatatctggctatgactagagatttcaaatatttggagggctattatgtgaagaactaaacttactctttgtgacatagaggtcagaaattggtcgtttccatagagtatgagagagacagaattgtgctcatcataagtatcttttttaaaagttagacttaataaaatgggctgccttggtaggtggtgagttctctgtcacgaaagagattcagccacttgctctgagaaagcatggagaatatcaacattgtaagggtcgaccacctcatctctgaggccccctcctcacttaggttgccattgcaggtggaacactgggctgagtgtcaaagaacctgggttccacaagctgtgcgaccatggctggttgttttggatctcattcctaatatctgttagttaagctgacccgtcaatactgacccacttcacagagttatgaagggattaaattaggtattacatgtaaatctgttttgtttgctttttgttgttcttttttgttttgcttttttctttgcattatgaaatcccaagtcaactttttccattcttttatttttttaaaaattgacatcatcattataaccacaaaataatttttaaaatggaaaaaaaaaactcacctgcaaccccacaatctaatacaataatcatacttttttccctttattctcctttattgtgaccaaggatgactttgggcattgctgtgaggaactatttcgtttaacaccctactacctgaacatgatgcgtactcagcctttcaccaccccccaagtagctacacatgatgtgataatagtattggtggtggttttagagagttggagagaaaactgaagttggatttgggtaaaagaaaaaagagtgggaattattttttctccattctaaagcccataaagcaatgttaattgttcccacccctctgctattctgtctcctcaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaaacccacactttcccattttgtgcctcccttcctagagttttagccaaaggtttagctaagtaattggttttaccagcgcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggcactgatgagtaaggttggtataagttcctcagatcaacaaaaacccattttcctgtaagtcttacatttagtatttaaggaactaaaacttaaatacattttgtgaaatggttgacacttcactgataatgatttattgcttggattaataaattttccaaaagttgtcttatgtagaatatggtttgcaaccagcagaaccattaatctatactgcaatgatatgcactatgtataattgtttaaaagcctctacttaatgatgtaaaatgctctatttaattacacatttgggtaaactgtatactaacatctgatggcatttttccactgtttgttgcttttttcaaatactttattgtacaaagctgttcttaatatttttcaagtttttttctttgaattttgctaatgttttccttgaattatgagcactgacagaatgtgcttagcacttttggctattcacacagcttttgagcatgatttgcatccaatatttacattgctagcaataataagccatctgtgagttttgtcaaaa

SEQ ID NO: 6178 - DNA, 801 bp, Homo sapiens
gctcgcaagcccggaagtaaccgggaacgggcaacttcgtagctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacgatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaa

SEQ ID NO: 6179 - DNA, 1493 bp, Homo sapiens
gctgggttgattgtgcgggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgcgggttagatagaggtcatcagccgggttgattctacaggttagatagaggtcatcagctgggttgattgtgcgggttagagatcatcagccgggttgattgtgcgggttagatagaggtcatcagccgggttgattgtgcgggttagatagagatcatcagctgggttgattctgcaggttagatagaggtcatcagctgggttgactatgtgggttagatagaggtcgtcagccgggttgattgtgtgggttagacagaggtcatcagctgggttgattctgcgggttagatagaggtcatcagctgggttgattgtgtgggttagatagagatcatcagctgggttgattgtgtgggttagatagaggtcatcagctgggttgattgtgtgggttagatagaggtcatcagctgggttgattgtgtgggttagatagaggtcatcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgc

SEQ ID NO: 6180 - DNA, 1776 bp, Homo sapiens
aggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggttttccccccccaccccgtcatgtacagctgaatcatgcagaatttgaagatcaagatgatgaagccagagttcagtatgagggttttcgacctgggatatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaacctgattttcggatagctgccacataagttgtccttgatctggataaatccataaaaattgtgaagaaattaaagctaactggttttccatataaaatttttaagaacacttcatttattaagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcgatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaacaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcaggg

SEQ ID NO: 6181 - DNA, 2418 bp, Homo sapiens
atagttacttgggacaacagttttagcagggctctctttctcctttcctgatctctctgttaagctgcctggctcatttgatatcacatccaaattatcagctgattgctctattgttttggacaatgccctgaagcataccaaaatgtgtctggaattggtgggttcttggtcttactgactttaagaatgaagttgcggacttttgcggtgatccaccctaccacatattgtctcctaatggccgtccagtttatcctggagcccttgcatgacacaggcctatcgaagcataggagatgccaatattttacctcttgggtactttctgtgtagaagattcataacaagaacaatacttattctgcaattctttatataaagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgctcctcacctttgacctgaaccgccaacttcccatcctccacttttggagagcgcgcctgatagctgctgcccacctgggcactgacatcctccttccgaccgggtgcggagaaagcacaaaggaagtagaccaaggagactgaaggtggttatgaagactgtgcatctctgaggacatcttaaacaaagatgacccaaatctttgatcttcaaatagtcgatgtgaactgcttaacaaaatgccctgggaaaactctgtctgaaacaagcagcttgggggtttgatttcattagttactggacaagaactggaatggagtgaaaaatcttcattcatttcttggtcagatggagagaggagaaaaaaagaagtgggtttccattcacttccattttctaactgatcattagttagagaacctttggaaaggtttagctcagttttttcttccaacttatcaggttcctcaagaaattcactgccttgagatgactttgataacccatccaaatccagtgacttaaaaccgttattacaagggctcttgctgttgtctgactctgacatcattgaatccaactcagagattttgtcaaggtaagcagcatccatcgatgcttcactggatgttcttgtccggttcatttcaaaagagcgaatagaattcaaccttttggataaacataagcctgatttctcactcaattttgaagatatttctccaacagaatttgctatcgtgttcccctctgaactttcaaaatctaagttttgggcatagcttgtggaacaacagtcccaaaatcctgtctttggggaagaaaaacattctgatttcttttcattttcacttctacttatatcatcttctgaagaatctttattagaaacatttgaagaatcacaaaaatcatcaaacaccaattttctgagatggtttgagtgctttttggaacctcctgcttggaccacagagctctctctattttctggagtactgagctgaaggcaactaagggacaaaggagtacaaggagctggaagatcataaagttcttcatctttgtagggtacacagtcacttggtttattcccccattctctttccaaataagtatccatacttgtatctgtcacatctaacattacttctacctgttcttgatataggtctttgttcttagaacagttaaggtctgctttgctggtactttcctgccttgcagaactggtgtcacacagtctgctgctggaaggcttcgctaggtgagaagaactggaggtggatgagccaggctgctttctggcactatcgccttgattctttgacaccacatcctcctcactgcctttgctccctttgccatctgcagaaagtgctgtctggcaaatggaattcatagcttctttctcttcacttgaattttttagctgtgcaacttgagattctagttcctctatatacttatcacttcgttccagggctttcttgaggcgattggtttcacgctcatactgttctactttggactgaagagcagcaactgcaaaccttccaaacctacaaagaatggaaagatagttaatcttataactcaagcttttttcttttcaaggtttgagagtgcaaactgtcccaggctattctaatttcacctaacagtgacatttcagaccactcaatgagtagggcaaatgccagatgtatattttcaaaaaatggtttccccacttacataataataaacatatgataataatagc

SEQ ID NO: 6182 - DNA, 2240 bp, Homo sapiens
ggcagggaggcggagcttgcagtaagctgagatggtgccactgcactccagcctgggcaacaaagcgagactctgtctcaaaaaaaaaattgtgaaggcttctctgatttttttttccaacagttgttctgaatctttagcatgtccagtaattttttaataactttttattattgtagtaaaaacataaaattaatgatcttaaccatatttaagtgtacaatagtgtcaatattcaaacatattattcaaaaaataatcaaaatataaaagcattttagtgcgatagtatttattggagtatgtatagcagctactccagccacagttttctttctctgtaacactcaatgattcctgaagtagaaagattcccagtacatatgtttaaatgaatgctatttttaaagatacctaatccagatggtatggctagggcctattttatagcctgtttaaaaaaataaaataaaataaaattgggtggtttgtatgtggtagaagtgaattccagcaaaaggagaattcattcatttagacctttttttttgtttgagacggagtctcactctcaccagctggagtgcagtggcgcaatctcagctcactgcaagctccacctcccgggttcacgccattctcctgcctcagcctcccaagtagctgggactacaggcgcccaccaccacgcccggctaatattttgtatttttagtagagaaggtgtctcactgtgttagccaggatggtctcaacctcttgacctcctgatccacccacctcagactcccaaagtgctggaattacaggcatgagccaccacacccagcccatttagaactttttactgagcacctgccatgtgctcgacacgtgatagttgtagaggatacagagacaaatagacttagtccctaagactgtgtgaatgagcatgtgtgtattacaaagtattggcaagatctcagaaacgtgcttagaaaagtgcagatgcactgttattcttggccaatgcagctgagccaggtgtaggtggatgactaccccaggatgttgagctgagaaacaggatctcagcctgaacccaatgtagctcagcagatgtttgaattatgtgatctccagcttttgggaaagatctgaatgtaagaggaacttaagagaattagcatgatattttaaagagaataactgcattacattctaacagcagacctgagtcggaaaacaagtaaagaatcgatgtattggtttgccgatggaagagcttcagtgagatctcagaccctgaccctgcagtgagccttggcaatgattgacagggaagtttgtagataacgcagaagtagattagtgtgccactgctccaggctgaaaatcagaaatgaaagctaaaatacatttgtacataagctataccttcaattgatagagcaagctgtgtgactcaaaacagcctgtacagaagtacgatggaccagctggaaggtatcaatagaagataaggaaaagttaactcttgacaccagggaagtcaacaaatttcaggacaacagtgaccaatggttaagatggtgactaagtgtaatcagaaaaaaatctttaactccaagtttagactagccagtttgtttaattggatttctctggtcaaaacctaaactattggtgctttctaacctgtggggatcagtgtgcatagaccattttgccctcgatttcagcataacatagtaaaaagactgggttttagattcaaaagtcatgggtttgtgatacagtgtacttactgattatgtgacgtcagttacttctctgaacctctttccttctctataaaatcataatgcttcactggattaatgaaataagatatttgtgaaaagaactctgtaaattataaaaagttaaaaacttttacatatagcacattatgtgactagtaagtactgctgtgtcttactagcgcaattttctgtggcagcattgacacgtatctcctaaaaatataaagttccccacgtttacaagcagcatgataggttcaggaagaggaggtagatgagaggtaacatcttattatttatgtaattatgggctccataagtttattttttaagcaccatatatgtgtgtgtttcaaaataaacataaggcatcatatatttaaacatatataaccataatgcttgtatttataaatcattttccaagaaagaataaatcaaaatttgaaattc

SEQ ID NO: 6183 - DNA, 1549 bp, Homo sapiens
ccggggccgattcagcgctcggccgccctcagcgcccaggtaccgggtcccgggcaccccccgccgggaatgcactgcctgcggcgggccgcgccgatcctatccgccccgccgctggccgcagggctccctccccggccgcgctggctccccgcctccccgagccccagcctcacccggctgtcatcaccacattgtagatgaccaggtacgccgtggccaggggccccgggcccttcttcttccgcgtgccgctggcgtccccggccccggccctgccaccgccgcccccattccccttcgctgctgcagtcgccgccactgccgccatgtcaagtgcccgaagcccgctctcctagcgcgagcggctcgggccggactacgcgaggagagggggcggaggaagggacgaggggcaggcggggccagggccgcggggcggagccgggacagggtccacggcagccgccatcttggctgagggcaaagacgctcctggcgctcccgtctttcggcttgcctcagttgccactgccatcttggatcagggtaattcccgcctcttgggcgctcccggttacaacctcggcgccatcttggattagttcaatgtagccaccctctccaggcccgctgcttctgccagctggatgttgcgtcgtccctcgctattcgccctcctataatcactgcttccatgttgaatcaaaacaattatgctttcgttctcccttcttcaattgccctatcttcacacctgaacactattgctccggtatcctgccattttggatcagggcggttgacggtggattcacttcccatcagcccttgaggctgcagggaccagccctttgtacagtggagaagcccaggcggcctagaatccagtgtcgtccgtgagtgcttggctggtgttcaagtgcatcttccagcctgagaccgcgtggactcgctcatcgtgagggcgagaggaggataagcccattgggctgtcggctgagagtgagaccatccacaatattgtttgaacatctgaagacatggggaacttgccatctgatatctgataacagacttcctgtaaagcaggactggtagtttcctgataacaaattcttcaatatgaaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagc

SEQ ID NO: 6184 - DNA, 553 bp, Homo sapiens
cttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggtaagaactgtctcaggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 6185 - DNA, 2064 bp, Homo sapiens
caaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacagggacttgcacttaggaatctgttacagtgagcacagaagcagacctgtgggctcatagtcttcaccccccacccatatatacaagatgaacagagtggaggttaaacaacttgactaaacaacacagttcatggtaaagcccaagactgtacctgcccatccactgccttttccatgtatcctggaactgagcatagacctcttcccaggcagagctgacagcaagtaaaggagatcataatcaggggaccaaacaactttgtctaaagtgtgaatgtcacctaaggagaagctgtgagatcagaagggtggggcagaggagcagacaccatgagggagagtccttgggggtacatctgccagactgacactgtctggcctgggcagtggaggggctagcaggaaccacaggtactggtggtgtggctactaccgttacaactgcctgtgcttggacatggaccctctgcaatatgcggcagtttcattcattgccccctacattctacaccaagtagaaatggaaggcaattggatacttcacagacaagatctaagtggagaaggaatgcgtcctgtggctgcagagatccttggagcttggaggggagagcttgagccccactgatgatgacctcccacagctcgccaactcagccctccctaagtccccatcgggggccaattctcactctggggttggggggactccaccatagctcatccatcatagggatgttggtatctactgtgggttgggtagggccgatgtgctgaggatggctcccccacaagcaagagatgtggatttggggagcttcccatcttgtgttgaaggaacataactcagaataataagagccaactataacaaacccacagccaacatcatactgaatgggcaaaagctgcaggcattccccttgaaaagtggcacaggataaggaagccctttctcaccactcctattcaatatagtgttgaaagtcctgatcacagcagtcaggcaacagaaataataaagggcatccaaataggaagagaggaagtcaaactatccttgtttgcagacagtatgattctatatctagaaaaccccatagcctcagcccaaaaggtccttcatctgataatttcagcaaagtttcaggagacaaaatcagtgtacaaaaatcactaacattcctatacacagtcgccaagccaagagccaaatcaggagcacaatcccattcataattgccacaaaaaagaataaaatacccaggaatgcagctaaccaaggaagtaaaggatctctacaatgagaatcacaaacgctgctcaaagaaatcagagatgacacaaacaaatggaaaaactttccatgctcatggctaggaagaatcaatatcattaaagtggccatactacccaaagcaatttatagattcaatgctattcctatcaaactatcaattacatttttcacagaactagaaaaaacttaaaattcatatggaaccaaaaagcctgagtagtcaaggcaatcctaaacaaaaagaacaaaggtggaggcatcacattacctaacttcaaactacagggctaccatgaccaaaacagcatggtactggtacaaaagcagacacacagaccagtgggacagaatagagagcccaaaaataaggccacaaacctacagccatctgatcttcaacaaagttgacaaaaacaagcaatggggaaaggtctccctattcaataaatggtgctgggataactggctggccatatgcagaagatcgtaactggaccccttttactatgtacaaaaattaagatggtttaaagagttaaaacccaaaattataaaaatcctgaagataacttaggcaataccattc

SEQ ID NO: 6186 - DNA, 2893 bp, Homo sapiens
gactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaa

SEQ ID NO: 6187 - DNA, 1724 bp, Homo sapiens
attataagaaaacaagtagtaagctcaaagccgctacaatcttcccgccctggagccagaggtggaaaagtcggccctatgcggcgggaacctgccaaggggcgccccaaggtgctccacgcggaggatccgaaatctgaaagcacaaaaaggcttggagctacagttgggggccaagacccttcttctcggccccttccagttcgtccataatttcctggcgcagcttcgggaaaaggtgcacgaactgcaggcgcggcagttctccagcaggaccactcttggcatcgccgtctttgtggcaattttacattggtaagatttaggacttttattcctacttcgagaccaatattgaagcaccttcatttttggaaggactggggacgataatgaatgacaggcttactgaaatcctcttggaattaatgcagtaaaatgcttccatctttatccagaggtaatcatagcctcctggtgtcgcacatccatgggaataatgaatttatttggactagaaactaagacctgctggaatgtcaccagaatagaacctcttaatgaagttcaaagctgtgaaggattgggagatcctgcttgcttttatgttggtgtagtctttattttgaatggactaatgatgagattgttcttcgtgtatggagcataacctgagtgggactcaactaggaggtcttattacagtactgtgctgctttttcaaccatggagaggtcacccgtgtgatgtggacacaacctctccgtgaaagtttttcctatccattccttgtacttcagatgtatattttaactttgattctcagggactgtattattcctatttcaagactattgtggaaacaccctcatttttgaatggagtatggatgattatgaatgataaactgactgaatacccccttgttattaatacattaaaaagattcaatctttaccctgaggtaattttggccagctggtactggatttataccaaaataatggacttcattgcaattcaaaccaagatatgtcggacggttaccagaggagaaggactcagtcctactgaaagctgtgaaggattgggagatcttgcttgcttctatgttgctgtaatttttattttaaatggactaatgatggcattattcttcatatatggcacatatttaagtggcagccgattaggaggcctggttacagtgttgtgcttctttttcagtcatggagagtgtacctgtgtaatgtggacaccacctctccgcgaaagcttctcatatccatttcttgttcttcagatgttgcttgtgactcatattctcagggctacaaaactttatagaggaagtttgattgcactctgcatttccaatttatttttcatgcttccttggcagtttgctcagtttgtacttcttactcagattgcatcattatttgcagtgtatgttgtcgggtacattgatatatgtaaattatggaagatcatttatatacacatgatttctcttgcactttgttttgttgtgatgtttgggaactcaatgttattattatgctgcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagat

SEQ ID NO: 6188 - DNA, 1662 bp, Homo sapiens
tttcactctgttgcctcctggtcccagtcacccttgtttctggtgacggctgacacactctctgaggcttcctttccccctccctgacctcccctggcccctgacacgttctctcttggatgcttctagtggtgcctggtcagtatcagccaggtggcgtcattcccctgaggagacccggggctgctggcctcgcccgtaggctgctgtggcgtggcccctgctcttctctccagcctcattttttttcattaacttcatttaatcccagtgcatcacttgtacctcttgcccccggatttcccttctgctggcctttgtcatgctgtctctctagctggtgcccttctcctgtctacttccgttggccatcggcatcctccaggaaggagaatttgagtccttggccaggcgtggcctcctgttcttggcttgccaggtgtggcccttgcttggggccaggcttcccaggtgccttctgcaggcaggaccagaggggcctgcctgcccctcacccggggtccccatgcacagttggcccccagtgttggcccccagggcatccttccctgtgtctcagacctgaggccttgggccctccgtgacggtcctcctgacctctagggaaactgctatgtctggaatctgacggggggcattggtgacgaggtgacccagctcatccccaagactaagatccctgcccacacgcgctacgccctgcagtgtcgcttcagccccgactccacgtgcgtgcagggcctgctggcccgggaggggacctgcctgggctgggggctggagaggggaggggctgctggatggagtggctgctgctggacacgccccatgcccacccactaggctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactgcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgac

SEQ ID NO: 6189 - DNA, 1391 bp, Homo sapiens
gtcatcaagctgcgcgggggcatagacgtccgggtcgggcgccgcggggcggaagacgagggcggcgaggtcgggttccgggcgcttggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggccgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagacagccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttatgaaatgagtcttctgtgctgggacttgctcattgcactctatgtgttatctcactccttacaacgacattcacatgaggaagcagattactttttggatttttttgtagagatggggtggtctcgaactcttgggcgcaagtgatcctcccgcctcagcctcccaaagtgctgggattataggcaagagccactgcgatggaaacagaggctgctgcttaagttgcccaaagtcttgcagagtgggatgtgagcagaggcatttgactccagggcctaagtccttaacacagctctgcagcatttaccctgatactcaaccccttccttccccaaccccccaccatcaggcattaagactactgcctaggggcagggcctggtggcagttgtgtcttatcccagccactgcagaggcaggaggatcgcatgagcctgagatgagaccagcctgggtagcatagcgagaacctttctc

SEQ ID NO: 6190 - DNA, 1536 bp, Homo sapiens
aaatatctgaaattttgatgccgctttgctcacaatgtcatcctttatcctttaaacctggagttgtctgaggtggtttgcaaactgcaaagcgccctgttcccaatgatgcacctgagaagtctgtaaatggggtaaatttaggcaaacacacctggaaaagtggcattttggagtggggaatgctgtggccggaggttagcaaccggatgatgcaaaagcgtatttaaggcagcagttctggcctttccccgccacggagcagaagcccccatagtgatgtgagaagcggcgctgtcccagtttactaggatgggatgggctttggatctaaccagcagcgaagaaaacctgcggtgcggctgcgctcggtagtaggggtccacaaagcgtcagaatctgcagcagccccggcctttgcgagctccagctccgaagtcaacccggcccccaaattccactgggaaaccttaagacaccggtgtttttaccgtaagaagacctcagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccccattacagttctatttggctaataatttacagaacatttaaaataccgggtaggtgaacatctcttcatggcttttgtgtaagggcctgaagcgaagagaaaaacaactgattggagattcctatctggcgccttctccagggaaactgacaaccagagaaatctgttgctaggatttctaggacatctggaaattccctttttgttctttctcaacaatataaaatggtatattcgcaaacctatctgaatcacctcaatctaggccactttgaaaatttcatttaaaaatgtaatcacagatttttaaactaattacccaatttgcaaacaaatcccagctacttctggtcttgaacatggagcaaaggtgtgtcagtaaggccaacattcttaggttgacagagacaggttaacacattggctggct

SEQ ID NO: 6191 - DNA, 716 bp, Homo sapiens
caagatcaaacccaggttgtgacagcaggtgtgttctgtttctccaaggcacactcccacccctgctaggcatgctattattgtctgtggtgttaggtgaatacctagaggaatgtttccattctgtaacaaaattatatgttttttttaatttgaaataaattttatgttaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaattaa

SEQ ID NO: 6192 - DNA, 639 bp, Homo sapiens; identical to SEQ ID NO: 4736

SEQ ID NO: 6193 - DNA, 1782 bp, Homo sapiens
gcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggccttccagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggtggggagctttcggcctgacttacaccacaggatctgggagtgttggctgaagatgtgtgctctcgggaggagtggggccgggcggggttcctggtgcctgaaaaaggccaaatgtgggcaaaaatacggtcacttggagtaagtagttgcaggggctggaagggcctggaggaggctcttgaaagggctgttgttggccgggctgaggctggcaaggcagagcccagctccactgccttcatcagggagagtgggtgaggccccagggtctgtccactcaaggctgcggggtgggagccctgggacccctctgccggctgcttgtggttctgctcctctggcattaggggacctgcctattccttgctgaacggagaccctcccacccccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctatt

SEQ ID NO: 6194 - DNA, 2210 bp, Homo sapiens
gcatcagggccgggggacgggtaaggggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagatttcagtttatatatttgaaccccctctgatgctgtttaacccctctaaatgacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 6195 - DNA, 1526 bp, Homo sapiens
tgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgaggtgggcgaatcacgaggtcaggagatggagaccatcctgactaacatggtgaaaccccgtctctactaaaagtacaaaaaattagccaggcgtggtggcgggtgtctgtagtcccagttacttgggaggctgaggcaggagaatcacttgaaccctgaaccctggaggcggagtttcagtgagccgagatcgtgccactgcactcggagcgagacttcgtctcaaaaaataaattaattaattaaaaaatgcagttttgctctcccagtgccaggtctgtgaggcccaggggaggaagtttggcagcggggcattgctgctgtctttttctttttccccagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtctt

SEQ ID NO: 6196 - DNA, 4377 bp, Homo sapiens; identical to SEQ ID NO: 2475

SEQ ID NO: 6197 - DNA, 324 bp, Homo sapiens
tgagcaccttgacatttcacctgaaatcttcctttccacaggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagca

SEQ ID NO: 6198 - DNA, 2300 bp, Homo sapiens
tgcaggcaagagtgctggagggcggcagcggcgaccggagcggtaggagcagcaatttatccgtgtgcagccccaaactggaaagaagatgctaattaaagtgaaggaaccaaagcggggagtgtgttcagtcagtacctgcctttctgagcctggcatcctggaccagcctcacttccttggctgaggcaggttctcactctgtcgcccaggcttagggtgcagtggtgccatcacagcttactgcagcctcgacctctcaggcccaagcaattctcccatctgagcctcctgagtagctgggactacaggcgtgtgctaccaccatacccagccaattgttttatttttttgtagagatgcggtctcatcgtgttgcccacgctagtctaaaacttctggggtcaagtgatcttcccacctcatcttcctaaagtgctgggattacagccgtgagctaccatatctgacccctttttgaattattattatttttgttttgttttgcttttgagatggagtctcactctgtcgcccaggctggagtacagtggcacgatcttggctcattgcaacctccgcctcttgggttcaagcgatgctcctgcctcagcctcccaagtagctgggactacaagtgcccaccaccatacccggctaacttttgtattttagtagagacggggtttcgccatgtttgccaggctggtcttgaacgcctgacctgaggtgatccacccacctcagcctcccaaagtgctgggattacaggcatgagccaccgcgcctggcctcattttgtttttgttttgagacattcttactctgtcacccaggctggagtgcagtggtatgatctcggctcactgcaacctccacctcccaggctcaagggatcctcccaactcagcctcccaagtagctgggactacaggtacatgccaccacacctggctgattttctgtatttttagtagaggtggggtttcaccatgttgcccaggctggtcttgaactcctgagctcaagtgatccacctgccttggcctcccgaagtgctgggattacaggcgtgagccaccatgcccagccgaatgattcattttcaactgctgtctctgtgtagctgacttcttccatatttttctataagattttacaattaaattcttcctgatttaaatcttgttaccttgtctctatggttctaaaattaaatgcatcatcttctgtcataagccatatcccaatacccatctcgtgtattaatcccatcaatcattcaggtgtctggaatacaattctttagagtcatttaaaattacgtggtccttttataagatctaatttttcacttaaaagctctttctgtttgatttttgtttccatctccattaccctcattctggtctcgggtcttactcatttatatgtttatgtctctgtaatacatccaaccaggttttcctaccgtcatatcccctctaaagtgtagtctaaaccaagacatgacgtacaaaaccataatgtgcaggtcttcctttagcttctttttcattatattactccctaaccccagatccttcattgatttcctcattgcagattactttggcaactgtctttactgtgtgaatcagttttctcattcatgttttttaacatacagtaaaatgcacagttcttaagggtttagttcagtgagtttttgacaatagcatacgttcatgtaattacaaaatctaaacatttgtattcctaccccctcaagagtttcataggttagttttgcttgttttagaactttatataaatggaattattgaatgtacaatttttgtatctggcttctttcattctgcataatgtctactgtaatctgtggtttattccttcttattactgaatagtattccattggatgaattatatcataatttgtttatccattctcctgttgatgggtgtttgagttatctccagtttctggctattatgaaaaagtcttctatgaacattgttatacgagtgtttttgtaaacatatgtttttatttcctttggataaatacctaagaatgaaattactaggtcatgtggtagatatatgtaactttaaaaagaaactaagggtttgtaccattttatattcccacctgcagtgtatgagcattccagttgctctgtacccttactagacggtacccttgtagcaccataaaaatgctgatgtcagtcatttttattttggctattatagtgttataatgttatataaattaaaacactatatctagtgtt

SEQ ID NO: 6199 - DNA, 3386 bp, Homo sapiens
gcgcgcgggtgctccaaggagtcggaggaacgcggccgcgcgacgggccccggacgccgagggtggtgcttcctccgagcctccggtggtgaggccgctctcagaaggtcatggaagcgcaggggagagcgaggcggccgagcccaggcaaatcctcgagaaaggccgagtgcgcgacggctctgcggggaggaccgcgcctccccgaatgcggccgctgctgccgctgcaaacagtgccttgaggagaggaaagcggggaaccgtgttttcgccgcctctgtaaccactgcacacaagaaaaccagcttctgggagagggggatgattgttgggactttgcgaattacctaaacagcccagggccgaggcgccgccgctcgcgtcctggtcctcctgccgggtgtggggctcccctgcccgagatggccagcgggcgcgccgagagtatcctggagccatctagtcttgcctcggaggcggggtgggcttatttgtgcggagaagaaacggatctcttaatggggtgagatttttcctccgtacattgttcccatttccgcagtttcacttggcctcggttttctagcagagtaatcaccaaatgaaattagctggagagcgtttgatggcgcagaatcacggtctgaagatgtttacgctgtatgccggacgcgtttgatggtgttctcttcggcacaattaattttgcaaagttcagaaatgtgccagacagagcccctggcacgcagtcaggactctacagacacaccttgagtaggaaacaggcttgtttgtttcatctgtgatttatgtgatgcaccagcaccaaggccaacgtgttttttaaagacctttcgatgaaactccaaagcaatttataaattggcaaaatgaagcttgttttgtaaaataactcttccttgttgatcatgtaattaaatgggcaacaaaacacctgaaaggacatttactgaaaagtagactcccaaaacaaaaatatgtatttcacagctagatacggtcgctattagcgtcctaatggccaactccatccatgtgcgtattttgaacactaaaaacgcctcctgttacccctaagaccttgtttggataacatttttctattataagtactcgaaaccaaccccatttaagatgtttacccttattcttgagtccttgatggtttgggaaatttatcattattcatattgcacaatcctgtcactgtcttttccattaggcacagtgcctaaggtccacaatatttttagaggcccacaaaaaatattttaatttcttttcaaatcagaaggaaaaaaaatttaggtttaagaaagtattttaatatatattaatatatttgtttttgtgctaatacaatcttaaaatgtatgtatatatgtgtgtgtgtatatgtatatatattttaatggagtaaggggctcaacgaaggcaaaaaggcctagagcccaagaaaaacatgatgtggccctgttgcctggggttgaaaaatcccattccatgagaagaatttagttttaagaatattacataaaatgctcatttctgtggccttgctataatagaaagatggagattcagagtagtgataatggctaacatccacctgatacacaccatgtgtccattacctcttaatcctcacagcacacctgtgaaataggtactattctcacacttagggggtaatgcaggttttgtggggcctgcaatttatgcaatttgggtggtcctcttaaagaaaaagcaaatactgtgtattagtccgttctcacactgctataaagaactgcgcgagactgggtaatttataaaggaaagaggtttaattgactcacagttccacatggctggggagacctcaggaaacttaacaatcgtggtggaaggagaagcaagtaccttcttcacaaggaagcggaaagaattgtgagcggaggaacttgccaaacacaaaaccgtcagatcgcgtgagaattcagttactatcacgagaacaacacgggaaaactgtccccataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggtgtctgtgcggtgcagaaactgtacaactgtatacagtgaccatttctactctgggtctctaaacaagggctggtatcgttacagagactgaagactgaggaagaccatctctgtaggatgccaaggattgactggagaaagtctggaattttccacaaatgagttcatttataaagagaaaggcaagctttgatgacaacaccttcacaaaatggaggcctttgaaaacattggtctggattgaggagttggagaagaatgaagtgcacatcaaccaaacagaagagaagcaatttggaggaggaaaaaatcagttcttcatgaaaggatcacattgatcttggttcatcccagtgcctcctctgcagacaatcttgtcctcagtctttcaattgttttcttcccatgccctgacaagcgaaccagatcaggaatttaggagcagcttacctaatggcacctggttacctaatggcaccctcaacagcttacctaatggcaccctcacttggttctggctccgggcctctcacaagattgtacacatgatgatggccaagtttgcagtcatctgaagtcttgactggagctggagactacatttccaagatggctcactcatattgctaaagcaattacagctcactgcagccttgacctcccaggctcaagcaagcctcctgcctcagcctcccaagtagttgggactacagatctttttcaatgcagaagcttaaagaagacactaaaaaatgtgtttaagatctctttaaactgaagtcttctgaacaagtgaagcaggtacatgcctgggaagacagccagggaacaggcagctacatcaaccaagaaggctgacaacatgttccatcccacaactatgtggtaattgcaaagatgagaaaatagcagagatcctccagtcagccctggaatgagtttaggggagagaaatcatgcaatctcttagtaacatggcatctgtaaattca

SEQ ID NO: 6200 - DNA, 2780 bp, Homo sapiens
agaccggaaacggaggagagcgcgggggatgtgtttggcatggggacgcactgttacagttgcgctcctggttggctttgtgtttccgcggtgttggtagagtctcggtgtttctacctcttagcaccctttcctgccaccctttgtcctgtggaagcccggagacatcagcggctgcaattttgctactcgctgctcggcatggaacggtcaggacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagaaaaacatattcaaggggaagagatgtaatagttttgacgtgacgacagttactaaagaagcacctgaacagacacatcaccttcactttgggatgtggaatttgctaaataagccacagaaaatgaacatcccttcagaatgggtttgaagagctgatccagtggattaaagaggggaaactgggagtttccaattaacaatgaagcaggagctgactaaggctttggaacagaaaccagatgatgcacaatattattgtcaaagagcttattgtcacattcttcttgggagttactatggatctgtaaataactgacgaaaaacccatctgtttctacgtagttgctgttgccgacacaaagaagtcttatgaactcaatccaaataattccactgctatgctgagaaaagggggctggcggcatggagtcttgctctgtcacccatcctcgagtgcaatggcaccatcttagttcactgcagccttgaattccagggctcgagccatccttctgcctctgcctcctgagtaggtgggactacaggcatgtgccaccatactgagctaatttgttaaacactttttttgtagagacgaggtcttgctacgtttcccagactggtctctgaactcccggcctcaagtgatcctactgccttggcctcccaaagtactggcataatagacatgagccactgcacctggctcctaagttcttttcttgaataatatctttctttttttttattttttgaggtggagtctcaccctgttgcccaggctggagtgcaatggcgtgatctcggctcactgcaacttctacctcccgggttcaagtgattctcctgcctcagcctcctgaatagctaggattacaggcgtgcgctaccacgcctggctaattttttgtgtctttagtagagatgcggtttcaccatgttggccaggcttgtctcgaactcttgacctcgtgatccacccgccttggcctcccaaagtgttgggattacaggcgtgagccaccacgcctggccaagtaatatcttaatatcatgccattgacatttatcctctaattatttcagaggtggccttcagaagaaggcctctttggtaaaattgctattgaggatatttcactgaaaaacaaatttatctttaaatttaaatccaggaaaaatttaaactttcaggcttctatttttatcagacagggtaaaaaatttataactcagaatattaccctttcccctctttgtgtgatggattgcttggttttagttactgattatttaaaataataagttattcaaatctaggattttgatacaatagttcttctctagaatatagtgtgtgtgtgagagtatatttaaaatttttattaaggcccatggggcagcctttgaggaaaccagaccttggggatcgccaggcaggattagtggcaggaattgagagaacagagccccacagagctcctcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaacaagagcaa

SEQ ID NO: 6201 - DNA, 800 bp, Homo sapiens
cggaagtggtgttgcggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaat

SEQ ID NO: 6202 - DNA, 299 bp, Homo sapiens
ggatgtgagggcgatctggctgtgacatctgtcaccccattgatcgccagagttgattcggctgatctggctggctaggcgggtgtccccttcctccctcaccgttccatgtgcgtccctcccgaagctgcgtgctcggtcgaagaggacgaccatccccgatagaggaggaccggtctttggtcaagggtatacgagtagctgcgctcccctgctagaacctccaaacaagctctcaagatagaaggattctaaagatgtgtattctggtaggttgtgtcaataaagctgattggatc

SEQ ID NO: 6203 - DNA, 3244 bp, Homo sapiens
gcgcactttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctagagagcatatttgtgtggatgggggtgggtaaacactcaacaaaagtttctttaaaaagaagaaaccatcctggtttgatgtaatcaatggttgcccactgctcccttcctgtgcctgtgacccttcccaaactgccctgttgcttgcaggctcgcctgagctgaaaggcagccctcacatcccgtcggcacctccctggggccttctttacaccctggagaacttcacagggaatctgtgtctgtaacacaaaggcttcctggtccagatgtagatactaaggctgactggttatttaagtcctgcggacttactctgccaaaattatttaatcatgtaaaaataatttataattcttataaagtatccccttcataatataatgaatgttggtgctattacatttaagtgcacatgtacagtatacaagattattaataataatgttttcaaatagttattgtcaaagctatttttcttatgtttatgaaagtgcttataaaattcatgttttatgaggctggagatgtatattttgtaatttcattctgatatttgttaatattcgcttccaatgctggttttgtttgatgagactgacattgcctaatttcaagctttttgaatgtgtattctttcagggcaagtatgaaataactagtaaaaaatatacaaatatgcttaacaataagtagactttctcacattgattacttacaacagctttatgtggggtgaatcagatgcctgtattacagaagcatctaatgcaaagcaaaataaaaacacttgcatgagcgcacagaggtaggtgtggaagaaagtgaaacactattttaggttttagttacactctgctgtggtgtgctgcctagtatttgcaggttaatgcaaatactaggggttatgaattgtttctaagtttattattaaaaatagccttgcttcatttcttcctaaaatggagacaaatatgtatagtgtctgtgttaccagtatgtgtaagagtaatatcttaatgcgtgtaaaatgtttataggaacctgtatttcaaagagctatttttgcaagtgacactatccttttaagaaacttttttattcaaactttttcctccatttataactattctattatttcttaatgttcagaacccttttcattatctataaggttaaattttaggtaagtaatgagaaaataataatatgtggagaagaaatgagtgaggagtcgagatgtgtgtcaatcaagaatgagtttgtcagcccttgtattatgattttactcgggaggggataattattgaaggatgtaatgtaagggcagtgatactatatggtatgtaagactgttaaaatcactgaggtaagctattacttgaactaagcatagaaatagagacagatttttaatgcatttaattatcaaaatatctaaattaaagatttgatgtggttgttcactggaaacaaatggcagacaaacagaatatttcttggaatcataaatgacatcatcctgtctccaactttctgtgtagcttctttctttagttggtctttgcttagatttccctgtgtcagagacgacttccctggatatcagtgacagttattgattgctcatgctatgaactcctcccatttctcagccctcttgcagtaggtggggccatggtactagttgtggcttattgcttaaagactttaaggctccatgtgtgactttccagctctggtccactgctactgcggctctggcaggactagggaggtgccccgtgtctcagatggtgcagcctccatccagctgtgtccctgaatgactagagcacagccactggtgacctgtggtggacgtagaatgtgggtaagagataaacttatgctacaccgctggggttcaggggctaatttgttaccacagcatagtcaaccttttctagcaccccattctgtctaaatttagtagtcctaccccactccatgcctccccaacccttcccctggctttagtttctttgtagcactggtccccgcatgacctgtcgttgctttactttctcgcatcacttctccctgcctccagcacatgcactaaaatttaaactccatgcctggacaaaatcaatgtttgttaaataaagtctgccagttctgtttgcgatttttcagaaacaaggaaagaaatcctatataaagttgatctgtgctttggcaatattcatttagggtaattgcccttttttcaaatggctgtgcattttttatgatgatgaatataaagtatttagcagaaatattttttattaaaattgttgagcttatggaatcaatgtagcagcctatgtgaaagaaacactgtgctagagagttgtctttctgccacgtgtaatcattacatttaactcaagttctccatgggagatccatgcagagatatgaaaataggacggacgtctcttccttcttaaaagttgctccagattttggcttcaagtgcttcctgttttttgccctcccttatccctgggagttccctctatttactttcacaaggactcttggtataaaagatatttgtatacctgggtgtgtgggaaggaattgaaggcaaaggtagcagtcatttcaagctgaacatgttaagtggtaatcgagcacttggtttttgtagtacctcctgtggccatctccacagtgtcatatttgaaagaaatcttgtgtaagcattggtctaagggtcactgactgtgaataatgaatgcggtgacagcatggccatcttagagacaggcaggccagatattggttactttgattttagttgacaaagtttatttgcttttaagttttaaagcaatacagcagtgtgaacttcaagttgtaaactttcatttagaaagtttaaaatttagttgaaatataaaatattctgaatctgaataaaaagttttaaaactta

SEQ ID NO: 6204 - DNA, 683 bp, Homo sapiens
gggaaccccaaggttttgtcttctcctcgggacatgtatcttcccctcccctatgggtcctggagtaagactggagtgggcagggagccccactgccacctccagctgcagcagtcgatgaagtctggcgtttgtttagcttctccactcaatactctaatcctgccaaagacctaatagactattgagcagtcccgggggagggcacaagcatcatccagcagtgtgtgttgtgttttacagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 6205 - DNA, 592 bp, Homo sapiens
atcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtca

SEQ ID NO: 6206 - DNA, 581 bp, Homo sapiens
gtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggtaggtagcataatgatttggcagtctcatttttgtgtagttactgaacttggtggctgtgattagtatgctgtaaataagcagagataattgtctaaccatcagacacctaagcattagatttattgcttttatgtgaagaatattgtaactgatttgaatataaactatgaattttctgtactccatagttcttttatggtaaatgcacat

SEQ ID NO: 6207 - DNA, 1000 bp, Homo sapiens
ctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggacttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatact

SEQ ID NO: 6208 - DNA, 2177 bp, Homo sapiens
tgaacatgggagtacatacatctgtttgaggaactcagagtggttttccagatgggaatcacattgctctctgtccctgagatcttgctggagacagggctactcagtccctctttgccaggtaatctgttccagaagaaacatgtgtcgttctgactgagcccctgcctgtctgtcaccttaagagccagtcaattcatatggtccccatatcaaagtctcctgtgcccagagagaggatttcatttcaaccatcaccatcaccaccatcatcatcatcaccaagagatgttgttgaattgatactggaaaagcagtttctattgagcccccaaatgaagagtgagtgcagatgaagaggaggcaggactcacaagcccttgaactttattccagatctgttagcacctacaggaccctgcaccaggatttcatctgtactatcagcttcttcaaagagagagaggttgttgaaatattttcagtccaagattggttgcattcatgtatgcagaatccacagatacaaaaggtcaactgtacttatttatttaattctcaccacaacctatgagaaggatctattgttgcctgactttagaaaaaaggaaactgaggtacagtgaagacagagttagcaagtgccaaggcttagatgtgaacacaggctgtgtggctcctgagtaaattcatctatccagtgtgtgctgctgcctctcaaatgatgagaaaaatcttgctttttcaggccgggcacagtggctcacgcctgtaatcccagttacagggatcacctcgtgatctcagtgatagataacaccagattgatattggaaaagcagtttcccattgagtctcaaatgaagagagtgcagatgaagaggagctcttcatgtggatgtctgagctcatatcaggtgtctgaaagaggcagattctgaggatttgggtcatgatggctgccaaagcttctactcctgacttaaagggcaacaatcctaggagaccaccagcacttacatccctggtaggacatgacacctgcttatggctcagaagtgacaaaagagaattatcaggatggcagtccttataaccagatgcttatcaacattcttcactacattctgaagatgaatttctacaagggaaattgtttatatttgttgttggggatagataaggaaagaagaaaaaggctctggtgagaaacccattgtaccttctggatatgatcactacccaattttatcagtgtcattgatcactaacccagtgcctcgtatggtgccaggcacagagttactccaagaatgtacaataatggctggattctctttctccctgtgcaactcttcatgcatgtgactgaacttatattaagtgtctgaaggaggttcgttctgaggatctgggacatgatgggtgctgaagcttctactcaagatttgaagggcagctgtcctcaggagacccctggcacttccctccatggtgggatgtgatgcctgattccagtgagttcatagagctgaacaaaaggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcagacacgtctttgcagaagagttctataatggtggtacaatggtgccccctcgtgacagaagcttgaactacagcttgaacatcgagatgaaaatatactgtctacgttgttcaacacaatagctaatggcaactgtggcagttgaacacccgaaacgtgatgaatgtgactgaggaactgaacttttagtttcattgtgacatgatgaatgaatttattgagccccaggaagaaggaaaattaaagaagagcaaagaataatagctggacagaagatgggggtcattgaacctatatcctagttgccagaccagtaaactgaccatgggacctgggggaggcagcagatgaccgaaaacctggagtgatgtggctgaataccgcatgatctgaagactgcactggtggctgcggtatgggtccaaatttttccttaacaaaaacaa

SEQ ID NO: 6209 - DNA, 561 bp, Homo sapiens
agtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctggccaaggaaaatgacttcaagcattttcattctgtgatttatatcaatgcctcagaaaacctgctgcctctag

SEQ ID NO: 6210 - DNA, 2069 bp, Homo sapiens
taagtatattattatatgttattgttaactataatttacctactgtactatcaaatactagaacttattccttgtatctaaatgtattcttgtaaccattaactaacttttctgaatttcctactctccccttcccttcccagccttgtaaccacctttctactctgcctccatgagacccattttttaatctcccacatatgagtgagaacattcaatatttgtctttctaggcttggcttatttcacttacattaatgacctccagttccatccatgttgctacaaatgacagaatcccattctttttcataatattgtccatacataccacattttctatatccatttatctgttgatggacacaggttgcaaagggattgctggattgtatgataattctatgtgtagtttcttgaggaaccttcatggtgttcttcatagtggttgtactactgtacattcctaccaatggtggatgagcgttcccctttctccacatcctcacaagcatttgttattttttcttttttttcaaatgaacattttaactggggtgagatatcttaatgtggtattggtttacatttccctaattatggttgagcattttttcacatatctaatggccattcatatgtcttcctttgagaaatgtctatacagatctctggccctttttttaaattttttttttttttgaattggggtcacccagtctggaggtgatctgggcttccacatcctgggctcaagtgatcattccacctcaggatgacccaaatagctaggaccaaaggcgagtgccaccatgctcagctaatttttttgtattttttgtagcgactgggtttcaccatgttgcccaggctggtcttgaactcctgtgctcaagtgatccgctcaccttggcctctcaaagtgcaggtactttaggcgtgcctggcctttttgtccattttatttttttgagatggagtcttgctgtgtcacccaggctggagtgcagtggtgcgatctcgactcagtgcaacctccgcctcccaggttcaagcaattctcctgcctcagcctcctgagtagctgggattacaggtgtgcaccaccacacccagctaatttttttgtatttttagtagagagggggtgtcaccatgttggccagggtgatcttgaacttctgaccttgtgatccacccaccttggtctcccaaagtgctgggattacaggtgtgagccactgcgcccagcctgtccattttttaatcaggttatgggttttttgctattgaattgtttgagttccttatatattctggttatgaatcccttgttagatggtgtgttaggccattcttgtgttgctataaagaaaatcctgagtctgggtaatttataaagaaaaaaggtgtaaatggctcatagttctgcagactgtacaggaagcatggcaccagcattgcttggcttctggggaggcctcaaggaactttcactcatagcagaaagcaaagcaggagcaggcacatcacatggcaagagagcaagagagagaggtggaggagatgccacacactgttttaaacaaccagatctctcaggaactcattgttgttagaaaaggaattaaaagaaatcaaagagtgtgtaagcagaaactcagttgtacgtaagaaaacccaattccccctgagaaagagaaagagctggagtcctttaaaaattcactgcctgtttttctggtggctagtgagtgttagctctcctcccttcccaggcattgtgaagaccctgtttccctagctgtgcagctgcaaggtcactagacagataaactcaagtcgcaaaacatgtttttccttgaaaagtaagaaatgatgtaatgcatgtcttgactgaataactgtctttgtttcttgcttctgtaatatgcttccccctgcacagatctccccctgccccacgaaatgcttaaaagctaacttaactctttgttcagggctcagtcctttggatgttaatctgactgggccggagcacctaaataataaatattctcctgaacccc

SEQ ID NO: 6211 - DNA, 646 bp, Homo sapiens
tccctagctgcaattaagttccaacatagcccaatttgaaagagattgagaaaccacagttctcattaagaatattcatgagtttgcaccttgaaaagccagcaatcacatgatatgccagaacggacaagatcgtttgagaagaggaaaaaaaaaaagatgcaatttaaaataagttaccagagaagatcattttacctcggtctggccagttgaaacactgtgtttgccattacacagtgggtgtttttgggatgtgactgaagtcagcctgagtccaatgaaaattctgaacttcttctggaattatggtgaaggacaaactctttttgggttgtaaacctggcaatgtgagtaagaatcttactgtagtgggagaatgtgcctgaggatgcagccaacacaataaaaagcagagtccggtagatgaagagtaatagtgttctgatgatgtcacttaaagcaccaagatccagccatgcctgaagttgatatacccttttcagttattaaaaaagtcaacaaaacccctttttaaaagtaagctagtttaaactggatttctttcacttatgtccaaaagagttctaattcatacaaagccctcattttataggcttaggaaactgacaccaaggacgatggc

SEQ ID NO: 6212 - DNA, 3629 bp, Homo sapiens
aggcccctatggcacctcctgggagggaagtcagtgtgggcaccaggatcaggcctgactgcagagcgcttcttggcctgctgactgagccccttaaatgactttgttttggaaaccagaaaacggattttttctgagatgttaggaaataatattttaacagaggccttgctctctagtctctggtttgaaggtatcattgtttggtttctccttctgagcacaagactcccctgttctgttctattctgttctttttccttccctgcagagaagagaacagaagaataacagcagaagatacgcagcctgtaatggactgaatatctgtgtccccctaaacccacatattgaaatccttcccccagtgtgatgctgtttggaagtggggcctttgggaggtgattgggtcataggggtgcagccctcatggatggatgaatgcccttctaagcccaggccagagggctagcttgctgtttctcctccaggtgaggatacaactagaagccagcagtctacaggctggaagaaggccctcaccagaacccaacccttggacttcagcctccagaactgtgagaaatacatacctgctgtttattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacaggaagtgctctgtggctaaaacaagtccaaaaagcacccacagagaggcaatgggtgagacaggaatcccctcacagtgggcgacagatctgaagtgaagacaggagatgatgagaaaagctcaccgcatcagctggttgcccaggccaggacctgaagggttgtgtggagtctggaaatattgtggacccaagaaccttgacctctcggtgcctgcgacgggctgactgctgggaatgaagcaggatcaatgatgggataaaaatcaagggtaagaagaggatgtaaggcagctggtgttaatggggagaaaagctcagagagatgcattttaaagctaaacaatggagaagggtttgagaagaacccaacaatgtgggagtgctacagcagggaaccatgaaacagaaacagcaagatggaggcagccagacaccaaactgggaactcagacacccagattccctccatggcctcacccctgggcaaaatccaactctgagccatcttcttcctccatctctttcaacccccacaggggctgcctgctcttcacagctgtggaggtgagggtgggcgtgggcgggatgctgttcagctgcagactttcttcctgggacgaggagacgtcctctctgttaggcttggcaggccctgccaagcagatgcatacattaaccacagcccagggcctgcgacaggtgtgctctctttccaagacctgcccaggatttagtaagggaaagtcaatcaggaagagaatggaaaacttatacagcttcattctgttgccctcaaatgggcatagccctatgtactaaatacatagccctatgtaccaaaaagtaaggcttagagaattgtagctaggccttgtccaagaagaacttgctacacagcctagaaaacaagatggaaagatatataaatatacatttcacagataaactgtaacaggtgaacaggtgaacacaaacatgagggagggttggagtctctaagattgagaggtctgagttagccaatgaagacatctgagatcctatccaagatttctgtggtcagaaaaagctgtaaatggcaatagagttttggtaccagaggctagagtggacaaatgagggccagggaggaaccggaaaatgggagacaggattttctaaaagctagaaaaaaatgaagtgattgcaatgccagtataactgatatgatatgaagggggacttatctcctgcagagattggagaaggtagaggaggagaaagaatccaaagattctcactgcctgagaaaacccaggcaatactattttaaagcatcagtcaaattgacattaacatctgttaactgtaaacagtcacactcccattaccccccttctccactaaaaacaataatcccaaagtgagcgctcagcctatgggtttaagcagagggctacagaaaacagggaagagacatacccctgggcttggattcccagagaggaaaccttggggccccagatgtgtcctcctgatctccctgagctattaatggtgtgatgcccgagggctgggcccttgagtctctcctcttctccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccatccttctgtcaggccaaaatccttggagccatcctcaactgctctttttgtcttacatcccacatccagtttgtcagaaaagcctattagagataccttgaaaatgcacccagaatctggccgtttctcggcacctccaccattgcccccggcctaagaagctctcttatcttgcatcttgggctggactcctacaacagccacaacctccctgctggtctcccagcttctagccttcccccatctcctgtcgttttcgacacagcagccagaaggatcctttaaaaacagaggttgatcctgtcgttcctcaaaatcctccaatggttttcctactgcactcagagtaaaagccagtctctgccttagatgctctgggatcctgtaccctctttggtctcatgtcctacaatctgcattctggccataatggtcttctctgctgttccttgaacattccaggaacattccccccatcccctcgtggcctcaggactggctgcttcctttggtatgctattctgatacacactaagcaccctccctcacctgttataaaaaattcgctgggaggccaataggctgaaatggctcctgcactttgggttcctaagtcagcaaactgaaactcaactcagagtgaaagtgttgtgtgtaacctaggagcaggaaacttcagcttaaccagtcagaaactaccgactaacctctaacaagagatttatggtcagttaacctctaaatatgaactttccactctaaccaatcaaatagtttctttgtcttgctcccagagacaccttgtaagtgtcccctctggtttcctcggtggtggcgccctgaactgctggcggtctgccactgcctgattgataaaattgc

SEQ ID NO: 6213 - DNA, 450 bp, Homo sapiens
tggccagcaccaatagaggctgcagagcaataggtgtaagttggcatttatatatttgccagtttaaaaatacatcataagtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagg

SEQ ID NO: 6214 - DNA, 615 bp, Homo sapiens
tttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttgcttctctgcagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatg

SEQ ID NO: 6215 - DNA, 1592 bp, Homo sapiens
gcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggtatggctgctgctatgtgctgtgaccagagaatcagagttctctttacttcttaccagccaacctcttgaaaatgcctttttgttttttgtttttttttgagacggagtctcgctctgttgcccaggcagtgcagtggctcactgcaacctccgcctcctgagttcaagtgattctcctgcctcagcctcacaagtaggtgggattacaggcatgtgccaccacgcccagctaattttgtatttttagtagtgacggggtttctccatgttggtcaggttggtctcaaactctcgacctcaggtgatccacctgtctcagcctcccaaagtgctgggattacagacgttagccagagcgcccagtctaagccctttatagcttaattctatatattaaattttcccagttcaaattactgtgtgcttcccttctcctgattggaccttgcttgatacaaaattagtacaaggagtggtctcaagagatagatgcacaaagaagggatatggggacggatttgggtatttgggcttgagtgcagactgagctccttgacaatgagaaataggatat

SEQ ID NO: 6216 - DNA, 581 bp, Homo sapiens
ggctgtgactcgcgcacctgcaaggccgcctccgggctgtggcgtgggagatgatagccagaaaccaggctgagacgcagactagcattccacttagcccaaggaccagtgaggaagctgggcatcctagcgcgtagccgctaaaggaatgggcagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagg

SEQ ID NO: 6217 - DNA, 581 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactgggtatcactttttgctaatagattcacttttgtataataatctggataaaacaacaaatgcactatgaaccctgcttgagggtgcttattataacacattgtgattggcaggatactcaggcacagaaagggttggtattcaaaatttactggtgtggtggctcatgcctgtaatcccagc

SEQ ID NO: 6218 - DNA, 520 bp, Homo sapiens
cttttgaataatgtgctttagaaaagaggcctcaatgttaaaatactttcacactttttgagaaaagatctaattagaatatgaaagaaattgccattgcggggaaaatggtctgaaatcacggtaacatttcttttctctctttttaaaaatcagatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaag

SEQ ID NO: 6219 - DNA, 564 bp, Homo sapiens
tttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataaggtgagttgtagagtacagaaattgggttcgtaagtattaggacttttctaaaaattttattttatatgaatttatgtttctatctgagtgttaaccttggttttaaaaagcattcttttaaaggttcaggcttcatcgaaaaacattcttttggatgttgagatttatcagtaaaatgacagtcaaaaatgtaggttcaaatcttaaatcttaattgtgtgctcatagagaagttatttttgtttctgtggttaaagtcccagtttttccacctagaaaacagagatgtaaagttc

SEQ ID NO: 6220 - DNA, 461 bp, Homo sapiens
gattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggatcccatccaggataccatattgcatttagttgtgtctccttagatgcctcttggctgtgacagtttctcagatttttcttgtttttaatgacctttctgtcattttttaaagtgctttttaaaggttttgtttatgatgacattcagcacttggaattgtgaagtcatatttatattaataaataacttgatttgtgatc

SEQ ID NO: 6221 - DNA, 458 bp, Homo sapiens
cgcatttcccctgcttgcactcaatccatcctgctaccccatgaagaaggtgcctgcttctcctttgccttctaccacgattatgcacccagagcaacaggcagatactacactgcactatgggcttccctcatggccatgactctttcactatgtcctggcaggcattgccacctggggtatcgttgtcatggcagaccccaaagggaaggcctaccgcgttgtttgaaagtaccaccagtgaatctgtcttctgtctctgtccctttccccgtgacacacacagcaggcatggaatttaatgggtgttctggacagacacttgtacatggacagacatcactactgtggatactacaagactgagaagaaaatcgtatgttgtcattctctggctatggagtgtttgtggccttcacagatttcacaggaaccaataaatccctcagagaagtaaa

SEQ ID NO: 6222 - DNA, 1223 bp, Homo sapiens
atcccagccccgcccctgccgcacggtggacgtggcaggcggcacttccggctgggctaccgcggctgcagagggacatctttcaagaacaggcgccggcctcggcgtccgccgcgcagttaggaaactgactgtcgctctctccggcctcggcgctgcttcggacgccccggcaccggcccccgttgctttgtagcattctgcagctgggctgcaggcgccgtgggcctccgccagttgtgttcgagacgcggttcggccacagaagttttagcttgtgacttttggcaagtcagtggccctctctgggcctcaggtgccttttttgctgtgagaccagcgactgtatttttaaccctgattttatccctagatctacccaacacatagtaggtgctcaaaagatatttatgagtgaatgaatgcatcatgagaagaaattggaccagatgaggccctgtgaagctgcttgggtctttttttgttcttttttttttctctcttctgagtgtccctggcctggactagaaattctccatccttcggccttctgcgagactgcaggaacattacttttgaaggatgctaaggaatccgagggatgaaaaaaatcaagagattgcaatgatgtcacaaaacaaggaaacaaggcaggaagttcttgtgtgtttttttgcgggagagagtccatgaaattggggggagtccaaagagggagtgtttctgtccttggaactcaccttttcttctttccatttctcctcttctccttcccatctagtgcagcatcttcactccgaagcagaaatttgccaaaaaagcatcctctttttatcagaaaataaaatatcctggtttcttagcctggcattcttggatccccacagtttgatcccaaccgacaactccttatttgaaacttcagattctcccaaaccgtcaccttcctcgtggacttaatcctggaaggcccttctaccccacttcgccttatctcacacaaacacagtctctctctgactgagataaacttgaacacttcttttcttttctttttttttttctttaaatttcgggtttcaaaatacaaatggcctaatcacaacatttctgtaatgttgtctaaattcaggtactggtttgaatagaggacaaaaataaaacaaggtttgaagactaagtactttaaaaacatatttatttaaatagaggcagggcctccc

SEQ ID NO: 6223 - DNA, 1317 bp, Homo sapiens
gagagcgcgagcgtgctgcacctcgggagctggcggctgagctgccaggagcccagcccagctgaatcgagcggagccggtggagcaggggccttgtgggtacccggttgggcagggagaggtgcggctctgcgacggaaacaatcgccagagatgccggggctagccttccccaccagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgcttacactgggtgttggggatgtttgctacctcctgctatttttgtggttttggttctcccactatggtaggacccctggccagcattgtggcttgtcatgtcagccccattgactaccttctcatgctctgaggtactactgcctctgcagcacaaatttctatttctgtcaataaaaggagatgaaaatattc

SEQ ID NO: 6224 - DNA, 556 bp, Homo sapiens
agaggctggagggaggaacaggaggaggaagctgagaaagaggctgagcctgtgcggcgtgtcagtgtcgttgtgggaggaaggccggtgagaatggagtcctgtgtcccgctgcaagtgcagcgagtgttctgaggatggagtggagctctggtgatggcagccgtgaggcgagagggtacatctgcagtgacctctgcacccgttggtaactggcagttgacaagacctccagggcatcaacctgatggcagaaaggggggacgttttcgtcgatctgcacttggaattgcaccctgccttctcccgcagtcaggctgggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctca

SEQ ID NO: 6225 - DNA, 801 bp, Homo sapiens
gtcccctctggaagtgaaactgctggcttttgcagccttcaccctgtaccaactgagctatgtaaagggacattcgaacagtcccagacagtgaagctgctatctcctactttcttagctaacatatagcagctgttcatagatcagtacttctcactttgtttgcctttggttcatttccagatttccaccaaaatgattgtttttgacaatgttgttcagttttatagtagctttttgagagaggattttctgaccatatcagtgtagtataaccagaaatcccatatttcaaatcttttgaaaatttttaaccatttagtattaatattgaaatgtcttaatttggtatataatgtcaagatgcccagtgatatttaggattttaatttcttaatctcagcaatataaaatatattatgctcttaatattaattataatgtttattcttaaacattttatttaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaa

SEQ ID NO: 6226 - DNA, 583 bp, Homo sapiens
ctcggcctcccaaagtgctgggattacaggcgtgagccattgtggcaagcctgtctttttattctttgttgctgaatcttcttgagattacattagcttcttggcgttaattttgttatcctattcataggtggtaatgataaatacatctattaaataacttaaagggtgcatttgtttatctttcatgttgagtgacatcgagtaaacatctcctacaaagataaaacttgtaggttttttctgaaggaagtagctgttgtgaagcaaacatagtgaatttctaatagaaattagaattttttaaatacttataaacactccttgcaagcatcttccctgcttacagatcaatgtctttttttcttcaagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggat

SEQ ID NO: 6227 - DNA, 636 bp, Homo sapiens
ccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagc

SEQ ID NO: 6228 - DNA, 499 bp, Homo sapiens
gagctctatgaagagtggctggaacttagaaacggttgcctctgctgttcagtgaaggacaatggccttagagctattgagaatttgatgcaaaagaaggggaaatttgatgacatactgttagagaccactggattagcagaccctgagtgataattcactatttatgattgaatgattatcatattaaagaggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaag

SEQ ID NO: 6229 - DNA, 2513 bp, Homo sapiens
ttgtctttaacctccctttgttgtggagaaaatgtgtcactaatcagtggtccaagggatatctagctttggttactcagttcctgcagcataacagatatgacttatgccagggaaggtagaggctgattatggagacacccaggaacaggaataagaagggataggtctgctccacgtagaacctccccagatcggaagttaagtcttggagagtttccaaagtgctgaagtaaaaaggagacttggagggcctttgcttaatgagcaagaggcttgtgtcctcccaagaacatgagggagttcagaagggagctatagctcacagacagaaacctgcccgctcaccccatccctcgtgactgggagcatgtttgctcagaattttctaagaggactctcccttcaaaaatccaatttgctcccagaatgttgtttagcctctgagaatctcactctttcatttccatctgtgaatggacatagatgtgttgctcagggatcagaaacatcagagtccagggcccagtggcatggtgttgcattagtagttagaaaagtaattggtcagctctactgtaaaagaaataagtatgtagtacagttttgtaaatgtcaggtctgttctattgttttgtgatctgaagactgtcaaactggttgataatcaaagaaaaggttggtggttagaataagtaaaatttcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtgaggccccaccttggtttgctccactgtggtgtgtagtctccaaacagcttaagggtttttaagttttctcacgattacctccactccactcatctactatcagcatcagaaaggttaacatccctgggaccattctacttataaaagagatgaactagtgtgctttctccccttttccaggtgtgccatccatatacaatctcctcttggccaagttcaacaaatgtttccagggaaccccgtgggttgaggcaaagtagccaagatgtattgagttaagtttttctagaggacaaaagtatttcttgtcccttttccctcatgctcatatgttttagctgaggcgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacac

SEQ ID NO: 6230 - DNA, 1133 bp, Homo sapiens
agcttctactcaagatttgaagggcagctgtcctcaggagacccctggcacttccctccatggtgggatgtgatgcctgattccagtgagttcatagagctgaacaaaaggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcagacacgtctttgcagaagagttctataatggtggtacaatggtgccccctcgtgacagaagcttgaactacagcttgaacatcgagatgaaaatatactgtctacgttgttcaacacaatagctaatggcaactgtggcagttgaacacccgaaacgtgatgaatgtgactgaggaactgaacttttagtttcattgtgacatgatgaatgaatttattgagccccaggaagaaggaaaattaaagaagagcaaagaataatagctggacagaagatgggggtcattgaacctatatcctagttgccagaccagtaaactgaccatgggacctgggggaggcagcagatgaccgaaaacctggagtgatgtggctgaataccgcatgatctgaagactgcactggtggctgcggtatgggtccaaatttttccttaacaaaaacaaaaaaagagcccaaaaccatactgactagtccaggaatagccattaggcaaacaactttttgctaccctggtgttaccgatttctgaactcaacaggtgaattcaaagatatgcctgtctttccagcatggggagctggatttgggtcagctcaggcgcatgatgttgaacagctcttatgagcttctgatagtgcccaggaagtacagaaacaactgtctacaaatctttgaactcaaggcatatcacagggacatttgctttcttcaactagatatctgttttctcataaagagaaacaatgagaaatggtttttcacaatgcctcgttagccctgaggctcagccatcccctagtgctgtgtcccaacatttaaaggccgttgaag

SEQ ID NO: 6231 - DNA, 768 bp, Homo sapiens
agcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttga

SEQ ID NO: 6232 - DNA, 894 bp, Homo sapiens
cagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacc

SEQ ID NO: 6233 - DNA, 3969 bp, Homo sapiens
ctttctgtctgggcttctgtcacccagcttgtactcagccttttcagaaggaagagaacgggcatttgtggagcgttttctgggtgccagatcccgatggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggggaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctcccccccccccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaat

SEQ ID NO: 6234 - DNA, 1062 bp, Homo sapiens
gcccaggctgagcacgatgccccctcaaaagggaggtgatggaattaaaccacccccaatcattggaagatttggaacctcactgaaaattggtattgttggattgccaaatgttgggaaatctactttcttcaatgtattaaccaatagtcaggcttcagcagaaaacttcccattctgcactattgatcctaatgagagcagagtacctgtgccagatgaaaggtttgactttctttgccaatatcacaaaccagcaagcaaaattcctgcctttctaaatgtagtggatattgctggccttgtgaaaggagctcacaatgggcagggcctggggaatgcttttttatctcattttagtgcttgtgatggcatctttcatctaacacgtgcttttgaagatgatgatatcacacatgttgaagaaagtgtagatcctattcgagatatagaaataatacatgaagagcttcagcttaaagatgaggaatgactgggcccattatagataaactagaaaaggtggctgtgagaggaggagataaaaaactaaaacccaaatatgatataatgtgcaaagtaaaatcctgggttatagatcaaaagaacctgttcgcttctatcatgattggaatgacaaagagattgaagtgttgaataaacacttatttttgacttcaaaaccaatggtctacttggttaatctttctgaaaaagactacattagaaagaaaaacaaatgtggggccttggaactcaagttgcaagaattgagtgctgaggagagacagcagtatctggaagcgaacatgacacaaagtgctttgccaaagatcattaaggctgggtttgcagcactccaactaaaatactttttcactgcaggcccagatgaagtgcgtgcacggaccatcaggaaagggactaaggctcctcaggctgcaggaaagattcacacagattttgaaaagggattcattatggctgaagtaatgaaatatgaagattttaaagaggaaggttctgaaaatgcagtcaaggctgctggaaagtacagacaac

SEQ ID NO: 6235 - DNA, 1022 bp, Homo sapiens
gccccggcgcgtcctaggtcccccaggtctctccgggcctccggctccgtatagccgcgcatcctagcccgaagctgatgctgcccggtcggctccggccttcccggctgcctgacccgccgggccccaagccccgggctccggcctgggcccagcggcctggagcgcggccttggcccgtctgcccgccgcctcgccgccacgacttcgcccgtctgtgccccaccggccgcacctttgaataggtagtcgtactcgtcgtcccgggtccccattgtcctggcgcttccggcgggatcggcgactccgcagccccaccacaaacacccgacgggggcggagccggcgccgcgcagagcggcggttgaatggcctatcagcggcgagtggagtagcgacgggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccagacagaatctcgctctgttgcctgggctggagtgcagtggcactgtatccggaattggggggttcttggtctcactgacttcaagaatgaagccatggacccttgcgagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaagaa

SEQ ID NO: 6236 - DNA, 447 bp, Homo sapiens
ggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtg

SEQ ID NO: 6237 - DNA, 2947 bp, Homo sapiens
agtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagccttttccttgaaacaaatttttctgtcttaaatagtaatctacagacttagtcttgaatttcctatcattgttttatcagttatggttaaaatttttacaatgagctagttttctttgggtagcttttgaagttaaatagtgaaattctttacaataaaagtgccactcgcaagtacatattcctcaagtcatccagataccattaagcagtaaatcttacaaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgcaacctccacctcccgggttcaagcaattcttctgcctcagcctcccaagtaacttagactacaggcacccgccaccacgcccggctaatttttgtatttttagtataggtaggatttcaccatgttggccaggctggtcttgaactcctgacctcaaatgatccacccaccttggcctcccaaagtgctgggattacaggcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 6238 - DNA, 582 bp, Homo sapiens
gccatggagcccgacgggacttacgagccgggcttcgtgggtattcgcttctgccaggaatggtgaggcggagggagcgggtgatgttagaaggcgggcgaggaatggctccagaactaacccctggcacctccccctccccacagtaacaacatgctgtaccccaaggaagacaaggagaaccgcattctgctctacgcggtgagcgccggggtcttccccggcaggtccacctgttcccagcgtggccccgccctgccccctgcctctgtgatcggactccctgttcgccctccgctgcacctcaagtgatcctgactctcatgtcctgcccatccccaaagagagtcctgtcgtcatatcctccgggatcaccctgccctctcctcccaatcttgtctggaatccttccgtgaccccctttcccccacactcgccctctcgtagtgccggaactgtgattaccagcaggaggccgacaacagctgcatctatgtcaacaagatcacgcacgaagtggacgaactgacccagattatcgccgacgtgtcccaggaccccacgttgccgcggaccgaggac

SEQ ID NO: 6239 - DNA, 435 bp, Homo sapiens
cgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttct

SEQ ID NO: 6240 - DNA, 2097 bp, Homo sapiens
gcacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaataggttaatgactgaagggctctggaaaggggataagaggccggcttccttccccagatcgcactccaacacccagaggactgctatttctcaggtggcagctatgaggaaagaaagaaaatggtgccctgagtccctaagaccctggaaggtggcttggtccccgggaggccttgggagctgatttgccagtgagaatttgaagtcctggtgtccaagttaaactcacccctgggaagaaaaaaactgttcaatcagctggacataatactcatcacactagatttaagacacactgaagaattaagataaaacatgaatggggcacagtggctcaagcctgcactttgagaggctgaggcaggctgatcacttgagcccaggaggttgaagctgcagtgagctgtgatcataccactatactccagcctggataacagagcaagactcttgtttccaaaaacaaacaaaaaaaccagatcgcagactgtggatgccacattaccttgaagcatgcaatcgtaggctttcctgtctctccttcctaaggcatcccagaatccgagtggctcggagccttcatcacactcgtgtattgtgactttgctgctactatgcagtcctgcttccaggggacatctgcaagggagaaactccaagagttctttataagtctggagagtgctggtgacccaaaattattattactattatgataacagctttataatagctttattgagatataattcacatgtcataaaattcactctttttatgtgtacagatttcagtttattcacagagttgtgcaactgtcatcactaatttcagaacattttcatctcccggaagaagaagccctgtacccgttagcagtcactccgcatttcccccatccttagtcctcagaatccactaatctactcctgtatttatggacttgcctgttttggacatttcatacagatggaattatataatatatgttcctttgtgactgagtttttaaacttagtgtaatgtttttaaggtgcatccatgttgtagcatgtatcaatactgaattcttttttatggcagaataatattccactaatttttttcatccattaatatgttggtagatatttgggttatttccatcttttggccactatgactaatatggctatgaaccttcatgtacaagtgttttcatttctcttgggtagatatctagtagagttgctagtcatatggtaactgtattgttaaatcttttgagaaattgctagactgttttccaagtaatgtgtaagggttccaattttcacatccttgccaatacttgttattgtctgctttttttaaatttaaaatttgtgggtatatactaatagtaggtgtatatatatatacatatatatatacatgtacatatatatatggggtacagccataaattattcaaaactaaatctggagatcagttcaccgtctcttctactttctaaggaaaagcaattcttactcatgaatggaaaaatgctctgcagtctctaagtgtgtgtggtggaggaggggaagttgacttgctcctagggagggatgtttaatcacatctaatgtgtcatgaaaattacacacatttttatacagaacaatacatattgactatttcttgtctttctctcctgctagaacatgaacttcatgaggacagagacttgggcttattcaccaccaagtccccagttcctaactccagtcctttggagttagaagcaggttgcccaaagttcatgatgcagaaaaaccattttttccgagatttataggataagtcctgtaattccagattgcttggcgccaatcaggtactcaataaatgtttgttgagtgaatatgtgaa

SEQ ID NO: 6241 - DNA, 563 bp, Homo sapiens
aaacgactggacgtgacagtgccctgcagactggttggaggtctcaggcaggccacacactgaatctgtcaaggtgttcaacctgttcgaaatgctcgttcctcggtgctgtaaagaaatagaacttaaacttaaatttaatttatttagtaaggccatttttacttcctgcagaaagggtacactcgccagcagttttgccaggagagtacactgaacaaaggagacagggtcatttataacgtggcgcgtccaccctactgctgtgtccggtttcctttggctggaacgggacctcacattctgtatttgtcccgactgactagcaacatagaactttttaaaagaggcaaaggcagaggagaacaaaggaagaaggaagtaacttgtggaatgctgagaaaggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagt

SEQ ID NO: 6242 - DNA, 534 bp, Homo sapiens
tcggccatcatgctggccccggaggccgttagcttagtcatggctctaaatatgtacctgcaatcggatgttgaggatcaccgagcccgcgacgtagaagtacgggaagttcatgcgcagctgccaggccagctcgaagaaggcgagcagggtgcgggagagccccttgcagaagacgccgtacgagtttctccagcatttggctctaggtgccaagggcacatgtgacaagaaggtgccagctttataaaccttggaacttcttctgtgtcagttctgagacatacagtttactaaaacacatcatgaaggcctgttttgaagagaaggggaataagactgcatctgttcatatgaggttctccagcatttggctcaaggccccaagggcacatgtgacaagaaggcgccagctttttaaacattggaagttcttctgtgtcagttctgtgacagaacatttacttaacacatcatgaaggctagtttggatgtggaggggaatagactccatctatccatatgaggtgagtc

SEQ ID NO: 6243 - DNA, 863 bp, Homo sapiens
gccgggggccactcctgcgtggtgcgagtgggaacgcgcgcgcgcgcctgggtgtgtgttgttagctgatatccatggcagctgcagtggcagggtgcgtgtgcgtgtgtgtgtgtgtgtgtgtgtgtactagttctactgtactggcagacgggaggaggcaggggaggaggggcgcgcgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatggtgagacacaaattcagtctatttcatagtttgtggtca

SEQ ID NO: 6244 - DNA, 1701 bp, Homo sapiens
gagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggggaaggcttcaacccaattcgtgaaggtatcaacacaggctagtttagcggcggaaggactcgtcagtatctcctgatggaataagtaccctttggcatcatcttgctagatccatcttccctgaaggcggtcccaccctcttccacggcagccaggtcctgatctgcacaggctgctcctgctgccagcctggatgggaagccatcccctacaacacacatgccttcctgtcgcagcctctctcctctctaactccaagctggagcacccaacactcttagcttccttctcaattacaccaaaactctccagaccccacttcttgccttgaccccaaaccacgaacatcacttagtatctaccaaccacctgccaagcattgttcacatataaaagttgacttaaaaagacaaagaatcgaccgggcgcaggggctcatgcctgtaatcccagcactttggaaggccgaggcagacggatcatttgaggtcaagagttcaagatgagcctggctaacatggtgaaactccgtctctactaaaactacaaaaatcaactgggcgtggtggcaggcgcctataatcccagctactcgggaggctgaggcagaagaatcgctcgagcccgggaggtggagattgcagtgagccgagaccgcaccactgaactccagcttaggcgacagagcaagactccatctgaaaaaaatacaaatagtctaaagaaaagtctaaaaagcagacactaccaccagctcctccttacagacgtagtaatggagccaggtatgaagactcagctcgagaaatttagtatttccaaagcgactgacgcagtgactggcagagttaacgctacacgctcaatacccctctctcattaactcggatctgccccgaggacctcttcccgcccgaggcctcgtggggtcacgctggcaggcagagcaggcaggctcctctccaaaacggcgctcgcctcctgggccccggtctgggctccgagccgtggcctcgcgagccctgcccagccaccctgccgagactggcccgcatgagccagctcagggccgcctcttctgccgcccaggcccctgcagcctcccgcagcccccaacccgctctcggcccggcgcgaacccgcacgaccgccgccaccaaccagctcggccgcctcgctgaagaaaaagaagatagcggaaccggaaaccacctaatcgccgccgaaagcgcttgcgcacggagcacgccggacgcctgcgtcacaattcgcgccgcgccttgggccccgccctgccgccatcttggatgctggcgaacgaagccgcagcgcacgtgggtgaaggtcgcccacccgcttccggttgtgggccccgcccgccgagtcacttgagacgattgcacctctccccgtgtttgcgtccgctgcctctaggccactgacaaccgctggcggttggcgggccctcagcgaatagctgaacggagtagaggagaatgttttctaataa

SEQ ID NO: 6245 - DNA, 423 bp, Homo sapiens; identical to SEQ ID NO: 3530

SEQ ID NO: 6246 - DNA, 417 bp, Homo sapiens
aagaagcatcgcaacctgggcctcagcatgctgctgcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtca

SEQ ID NO: 6247 - DNA, 715 bp, Homo sapiens
gccggaggtcggactcaggaggctccttctccactcccggaagatcatgtaccagcccagccggggtgcggcccggcgtctcggcccttgcctgcgcgcctaccaggctcgaccccagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctag

SEQ ID NO: 6248 - DNA, 328 bp, Homo sapiens
attggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggtatggatggaatggggcactgggcaaggggcttggtctggcctatacgcatcctgccttcactaggacacccttgttttcaggcccatcaccctgactgtagccaagtgctgggacccaagtccacgtggttgcttcacattgcccaggagtaagtggatgggagactcagtcctaaa

SEQ ID NO: 6249 - DNA, 2453 bp, Homo sapiens
ggggtagcgacaagaagattaaaagagggaagcagaggagttgggagctggcggtcgttcccggggaagaactgctaaaacatgagaccaaggcacagaccttactgtatgagaagcaatgctcctcaaaccttctgcgtgctgacatagaccttcccagcaaaactgttggcggcgacctgagcgctggaagccgaaggggaagaggaaggagacgcgaagccagggcggccggcacaaaggcggcggactcgcggcggcagcgcctgcccggccgggagcacaacccacggccctactccagcgaagtcccgcaccggcttctaggaataaagtttacgttctcctgaggccgcaccccccacctcccacccaggacggcacatctccgtgtcctcctcccccaaactccactcgggaccccgagaaccaccccagccttccggccaccacaacaaagagccgcaccgaccggcgaggataaacagcggcggagggcgagagggcggcggggcgagcgcctccacgcagcaactccggagtcccccgcttgcccgagcgcagtttctccgctgctgtttccaccggctttgtaacactgggaatttacatcctcacccgcacccctcacgcccgaggattttaaactcacctttactctcgaactgagagttgcggtagatgggatttttgccttttccccagatggttgaaggttaagatttttggaaaccccaccacctccttatttctattattatttctgcaagaaaagtataaagagagttgtagtggaggtgagatttgtgatcgggaaagccttcgactccctccttctccgtcttccgcctctctctctctgattagttcctatccagcagcagattgaagcaggagatgattcttctcaaggtttgttcagcagcttcacttctaggcgaaggcttcatgaaccaagtgacgtcaaccaacaaggcttctctctctctcctctctctaacaatgaaagttgctgttaacaagggaaaaaaagagagagaattgtttataccatttcagttccaataataaatgacctatcagctcctaaaggagccaagggagggggttgcttcttctttccaagaatactgtagctttgagtttgcaccgttccttgtcccaggaaaaagttaagaaacttaaaatgttttgttttgcttttaaagaagacaggacagaaaacgggatttaaaacttagtttttaaaaaaacaaaagctacagagtagggagcataggtcaaccatctccacctaaattttttttgttcctaaactcagaattctacaacccaactaaattaatatgccaagattttgcggatgttaaaactcaaaaaaagcagtatgcaagacggtcccggggtaaaattctactgcctttccacggacaagttaaactggctgtaatgtttatgcactaagttaaaataaaatttaaataaaagacgttaaaatagtcgttttaaagttatatgcacacactgtaaaaggtaatctcgatagctttttttcaagtttctgagagattagaaaaaaagcatagcaaattgtaggcactgaacactttttaaaaatcaagttatgagtaagactggtagccctttgctcctttaaactacaaatgcagtcatatgctatggtctacccccagaatctcttccaactttgtttttacccttccactcccccaaccccaattcccaaatcctgcaaccaatcaagttaaactaaagatacaataggccccattccctcccgcaccccatcctatagattcctaaaaacaatttttttaaaagccttaatcttgataacactttattagccaagaagatacgtatttttttttttagaagttcgttgaggtaccgttttttccctccagaacacaagaaagtctcaaagttcatataattaaaaattgcataatttaattttcaggatgaagagtaagtaaaaattaagctatcggagaataatttgatcatctatgtatattttatacatatgtggataaatgtatcttaaaagatgctattgttttatgtttcctcttcagccactggctgtgattttaattgtgctggaggatcttcattagtattaacacatggggagatttcacaaagctgcttcattaggaaaaaaaaaaagcttggcagactcggtctttttgcatgcactgagaatgtcagccttacctcggtcatttgtaacataataagtgcaagtacaatgattgcaatgcaggagcactgggggaagggcagaaatactgcctgtctaatagggatatctgaaaagaaggctgctcattacagagtaaaatgtatgctaaaaattagtgaagatgatgtctcaggagactgatgctaaataaattaatgtgctgatatgtttttaattatta

SEQ ID NO: 6250 - DNA, 461 bp, Homo sapiens
ggtgagcgcaggtacacagaccaggaagtatctctgctcctaacctctctttatgtatgcatgaagctaattgttcaagtccaggggaaactggtgagagacggagtttcaccatgttgcctgagaatcatgtgatcctcccagcaatttgaatggacacaaaactatgtttgaaatacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgt

SEQ ID NO: 6251 - DNA, 2644 bp, Homo sapiens
cggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtaggtaaagaagccagaccacttcaggctccctctggctttattaaagcaagataaatccatggtggaaaatcagatttgcaagaaaaggtagttgaactaggttgcttattgttgtctagacaagagaccagcttggactagtaaaattagtgaaataagatcgtttatagttggatgacagagccaactagacgtggtaatagtggaggtgtccataactgctaggtgtccagcttgcacactgatgagcataatgaccctagattcagctggggagcagcatttaaacagctgaatttttaaattacctttgagaaacccaaatggtctttttgcagtagcacattactcagtagtctaaactacagaaataaaccttaaggccatgggtataaatgagatctgctggtggtagaggaagagggcctagggtctgaagtttgagaaactccactaattaatggcaaggtaaagcatgataagccagaaaggatggtcagtggtaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagtagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtacaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaagt

SEQ ID NO: 6252 - DNA, 1098 bp, Homo sapiens
cggcgctctgacgccgcccccgccccacagcctccctccccgggaggggcgcagacccgatcgcccccagtcccgagcctccgccgccgcgagggggccgcctttggatccgtgtaatccgcctctttttttctattttctttttttttttttttttttttttctaatttttggttggtggcggcggtgctgggccaggggaaggaagggacacggaggccgccctcgccccgccacctcctaccagcttccccccagccccggctccgggagatgtgccgggcggggggcccgggttcgccgagccgcaggagagacacgctgggccgaccccagagcggcgctggacagagccaacacagatctatagatttctttgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaag

SEQ ID NO: 6253 - DNA, 2811 bp, Homo sapiens
gcatgctcatctacagaaacgccgcttggcctttggactacaccatctgtcgctcgctctaacgagccggcgttgccgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcagagtgagactcacctaggctggactgcaatggtgcaatctcggctcactgcaacctccgcctctcatgttcaagccattctcctgcctcagctttccgaatcgctgggattacaggtcacgacccccaggagacctggaggactgaatgctgctgcccccaaggaggaggctgctgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtcacgacccccaggagacctggaggactgaatgctgctgcccccaaggaggaggctgctgtcttatcccaggagggagagcaggtgaagtccccaggggaggaagcacctagccccattcctgctgagcaggaggtggcaggtaccccagactgggaggtaaggacagcccggggcttcgactgaacgtctccagcgtgggtccaactgagcagccatggagcactgcagagtgggaggcagcagggcagggaggcagtgctggaggctggctcaaccccaagaccagcaggccaagctgccatcccaggggagcgaggacgtctgtgcagagctgagaggcagcagccatgtgtgaacagactgggcctcatcctggccccaccgactttgtgtggacagagcctgtttccctgtctgtgcaacacagaacctgcctgatctcactgctggatccctcttcttcctgccaggaaaataaaaaggttcaaaaggaagttgctgcgtatccatctgaggcctctgaggacagcaaagagcaaaggccctgggaccgggtctacgtgcccatgacagagctctggctggactggttctgagcctctaacacccccaagactcagaaccgtgaagaaaatctttccaataaatccaagagttgctgctgctataggccaggctgccacctttcggggcctccgtcttcagacaaacccagcctggcttcatccacactccctgtccccacagctgcaggaacagcacttcctgccaccgagccgtgtgaccacagtggattgtctctggaggggcccaagggggccctggccacccttctgactgactcggtgccaggggacagaccaacgtccctctcgtgctgacagccgggccgcaccctggcatgagggcatttacagaaatgctggcggaactgctgccagggaggctgtagggtcctctggcaaaagaggcctcaggtggctcctcagagtgtctgtggttctctgtcccaggctgttccctaagaaggtctgcccaggactcaggtaatcatatgctcattagaaactcttgggcactgcctgtgtgccc

SEQ ID NO: 6254 - DNA, 1793 bp, Homo sapiens
ggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaact

SEQ ID NO: 6255 - DNA, 776 bp, Homo sapiens
tcgccaggcttggcggctctttctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgaggtgatacaaattttaatttattacttataaaataactgatctcataataagcatcctacttaaggaataagttaataagaccaagtaataattccatgtggttagtaaacaataagtttttagatttaaaaacatactatttgtttaaccatacctaatctttttctatataaatcatagtgctttgcatactgaagagaataagagttacattttatacatataaaaccacataaaacaaaatctttgagctatatatataaaatttgtatataatggtttcagagctgagagtaatacggcattttctattttatttaatcctgtactaaatgtctttgtgacttaaaagtatatttctgtaattaagtcagaattttaagttatgttatccactatagcttatttttaaatttagaaaatcagtttttaaaagtataatataaaaacaaatgcattttg

SEQ ID NO: 6256 - DNA, 693 bp, Homo sapiens
gctcttgttgcccaggctggagtgcaatggcatgatctcagctcagcacaacctccgcccccgggttcaatgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagca

SEQ ID NO: 6257 - DNA, 7289 bp, Homo sapiens
tgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactccggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcttaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagaaaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatgaatcttaatcttgttcattcccctgccaaaacaaatttaaaagcataaacctgctgaattaattggcagaattcaccatagtttatatcaccccagaatgtttatgtgtatatgtttatgtatagtatatatatttcaagctgaatgttcagaaagaataaggtgagtttcttggtagcttgaataagaattagatcataaaaattataaataatggccttctcaaagaggataaatgattcatttttcactcacgtattaataatatgacttgttgcataatacacaagctggtcattgcctgcaagaaagttattgaattaagcagctatccaggtttatgtctgagtccatttttaacccaacaaggctaggattgaactccatatgcagagggtttctattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaa

SEQ ID NO: 6258 - DNA, 802 bp, Homo sapiens
ctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagag

SEQ ID NO: 6259 - DNA, 2273 bp, Homo sapiens
ttctttccttgtggagtccgaagcgtggccacgccccggtcaccggaaaaatccgtgtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagggtaacactggcctcacagaaagagttggaaagtgtttcccccttcttctatagccacccagctttgtcatggttgccatttaaatgatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaa

SEQ ID NO: 6260 - DNA, 813 bp, Homo sapiens
atgggcgtccgctgccaaaatcagtaaaaaggagctcaactccaaccactacagggccgacgagacctcaggaaaaaaaaaacagcaagaagcaattgaacacattgatgaaatccaaaatgaaatagacagacttaatgaacaagccagtgaggagattttgaaagtagaacagaaatataacaaactccgccaaccatttttttcagaagagatcagaattgatcgccaaaatcccacatttttggataacaacatttgtcaaccatccacaagtgtctgcactgcttggggaggaggacgaagaggcactgcattatttgaccagagttgaagtgacagaattcgaagatattaaatcaggttacagaatagatttttattttgatcaaaatccttaccttgaaaataaagttctgtccaaagaatttcatctgaataagagtggtgatccatcttcaaagtccactgaaatcaaatggaaatctggaatggatttgacaaagcgttcaagttaaactcagaataaagccggcaggaagaggcagcatgaggaaccagggagcttctttacctgatttactgaccattctgatgcaggtactgatgagttaggagaggtcatcaaagatggtatttggccaaacccattacagtaccacttggttcctgatatggatgatgaagaaggagaagaagatgatgatgatgaagagaaggaaggattagaagatattgattagaaggaaatgaggaagatgaagaagatgaagatgatgatgaaggggaggaaggagagaaggatgaaggaga

SEQ ID NO: 6261 - DNA, 292 bp, Homo sapiens
tcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtaagtctcgggtgtattattttaaatatttgtatgtgggtgggtgttcagcatg

SEQ ID NO: 6262 - DNA, 230 bp, Homo sapiens; identical to SEQ ID NO: 2535

SEQ ID NO: 6263 - DNA, 10186 bp, Homo sapiens; identical to SEQ ID NO: 2381

SEQ ID NO: 6264 - DNA, 871 bp, Homo sapiens
gggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagattactactttgtaaccagggaggtgatgcagcgtgacatagcagccggcgacttcatcgagcatgc

SEQ ID NO: 6265 - DNA, 574 bp, Homo sapiens
tttttttttttaaagtactaaaaaaaaaacaagttttgtaattagggggaaaataaatacatgtgtaccttacaggttgtataaagtacaggagattattaagtcatccagaaaaaaagcattaacatttcttaagcccctttggcaggggtgggaatgagtagagatttttttctctcttgagtgaagtaacatttagttgaattgagggagtaaagtaagatttttgtctccttttccttgcagggatataactggtgccatgaccggaatgtagtaacgattttcagtgctccaaactattgttatcgttgtggtaaccaagctgcaatcatggaacttgacgatactctaaaatactctttcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgt

SEQ ID NO: 6266 - DNA, 834 bp, Homo sapiens
cccctaagaagccttctctgaccactccagggcacaatgatctcaaggttcagcatctccagagatgagctttccaaatacctgatgaagatatgcatgtgagaaggaattaatgacaggcattaacactatattggccagaggactcattagctgattccgcaggttttataatatgctactcttgctaatatacaccactatttttcttaattacaaatgcaacatggaactcaggtgtttagggctatgaaaagaaaaaatgggcaacatttatagccagaaatttctgtaataagtttcacaaaatattttgttacactcttaaaatatattacatcaattatcctgtgctagaatatgttgtaaggacactcacttgagacgtaatcagtctgaatactcgcagagtctcagcttcacagttcctctgctgggccacactggctgaaatctggccagctatttttgtgctttcaccatctttccagcccaggactttgacttgtcgaactctcagtgtattttctgggccttttaattcaatttttatgatgtgattatcccctcctggaagttcacttgttacccagccaatgtgcctggaatccagatcaacctggttgagtagaaaagaggcaggaacctgattcagctggatcacttttatcactgtgctggacttagcattgataccagcaagctcaaataacaaagaattgcacagagtaaaggttatgaggttatttcacactgattttcttatttcaaccaggtgaagataagtaatattatttatagtagctattacacagatgaagaaactaaggttaa

SEQ ID NO: 6267 - DNA, 2677 bp, Homo sapiens
gtgagttctcacaagatctggttgtttaaaagtgggtggcacctgccctctctctctctcttcctccttctccagccatgtaaggcatgcctgcttccccttcaccttccaccatgattgtaagtttcctgaggcctccccaggtgtgcttcctgtacagcctgtggaatgttaccaaagacgttggaagaggtggctatggacatcacctgggagaagtggaagcaaatggacactgttcagaagtccatatacagaaacatgttggaaaaatatagaaacctggttttgctagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatggaaaaaaaaaaaccttgtaaatatagtgaatgtgggagaaccttcagaggccacatcactcttgttcagcatcaaataactcattgtggagagagaccctgtaaatgtactgagtgtagaaagggatttaatcagagttcccacttaagaaataatcagaaaactctttcaggagaaaagccctacaaatgcagtgagtgtgggaaggccttcagttattgcttagttcttaatcaacaccagagaattcacagtggagagaaaccttatgagggtactgaatgtggcaagacattcagtcgtagtacataccttactcagcatcaaagaattcacactggtgagaagccctatacatgtcttgaatgtggaaaggcttttagtcagaacacacatcttactctacatcagagaatccatactggagagaaaccttatgaatgcaatgaatgtggtaggtcctttagtcagagtgcacatcttactcaacatcaaagaatgtatacaggagaaaaactctatgaatgtaatgaatgtgagaaagccttccatgatcactcagctcttattcaacatcatattgtccatactgcagagaaaccctatgaatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaaccctatgaatgtaatgaatgtgggaaagcctttagccagagcacatatcttacaaaacaccaaaaaattcatagtgaagagaaatcaaatatacatactgagtgtggggaaaccattagacaaaactcttcttttttacaacaataaaaacctcacactggagagattctctgaatgccttaagaatttggttaatatggagacccttcccagggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaa

SEQ ID NO: 6268 - DNA, 599 bp, Homo sapiens
tgaattttcaccaaatatttagtaaaaagagtatgatgaaagaaaagttgtatttttaagtgtttttatataggaattttaaaatatataggatattgaaacattcagttagtatgcttctttaattttttttctccctgaaattataggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaat

SEQ ID NO: 6269 - DNA, 723 bp, Homo sapiens
tccgtctcaaaaaaaaaaaaaagaaagaaaggaaaaattgagaccaaagaactttaaaactggtcactaggtaatgtgaagctgactttctattaggctcatgttacactcttacaaggcatgattatatatggtgtggaaattgtattcaggctagtgtaagttactagtctggtacaaagaagggaaatggcagtttgtatgcaggatagaccatcaaatgctttacaaaggagagaacagttgatctgatgctcacaccatgaataggacttacccattgaagcaggttggtttgttcataaagataaagggatgcccattcaaaggcacagagattaagaaaagtatagagaactgcaggtaattctgtaaagaacctaaaaactaaatcagtaaaagtagacatggctttcagagaggagtcataacatagttgaacatacagcctgcattaaaactttggtctccttttgtatccgtatgcctgtggagagcacagagtacttaaagccaatgttattttaatggaatttcttcagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtgg

SEQ ID NO: 6270 - DNA, 3094 bp, Homo sapiens
aagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagattattttactttattttacttaaaggaaagagaatttattggcaggatattgagtagcttgtagagtatatggaaggggagagccaagttaggaactggcaggagcgaggagggacaagacagctgcctgcacagtctgataggacacatctggctgctgccactggatgcccacatgggcagcgtgttgtaaatatcaccctaccagttggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttatttt

SEQ ID NO: 6271 - DNA, 603 bp, Homo sapiens; identical to SEQ ID NO: 5898

SEQ ID NO: 6272 - DNA, 857 bp, Homo sapiens
agggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagatgaggagatggaggccagagaggatgggccacgggccaaggtcattgtcctgtggagctgggatttaaatcccaaccctgtgcccacagagccctgaccttgatggctctactttcttggggattcagtcactgcccctgccacaccatcctccccttgatcagacccagggcccccaacacccgaagaagaactgtctgcagctagagcctctgaggaaggactgcactgacacagccgtgatgtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgctta

SEQ ID NO: 6273 - DNA, 376 bp, Homo sapiens
gcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttgga

SEQ ID NO: 6274 - DNA, 1190 bp, Homo sapiens
gaaacagaaacttggatctgcaagaaggagtggagagcagcagaagtgatcattcattcaggacatgctgcatctggggttggcatcatttcccttttgaatgacagaatgtgcataaaagtctcttgcccacgctgaactcacacgtgcccggcaggaaggagctctcacgaagtgccagctggatgtgagcttgctctggcagcagcagtgctgtccttgtttctgagctgccacctattcactggagttaggtgggtcaaagctgaaatttagcttggaatttaagtttctaattttatacttttcattgtggtctggtcagattttagtctgcttcaaaatcaaaaggtcactcagtcactctaatatgatcattttgaatatggaaatttgttatttacatgctgtacctcaaatcaaagaaaaagcacgcgtcaatatcacgcgtaggaaaaactagaaaattgttccttttccattttgccaccctgctcagttttcctcataaacggttccagcttggaaaacaagagcttcccctctcagacagatgcagcagcgggaggaagggctttggtcttaaactagaagctgcagctgaaactctccccgtctaatcctgctgtgtgtatggctcacaccatctttcctgagtggggaaaaccgctggcactgaatagctgaaaggctcgctgaaatctgtgcttcaagaacgagttaaagacaatacaataaaacacatagacactgaaggggttcaactaatgtccatcacttattctgctaatgtcagtgcctttcaataaacttctcaacatctgtgttggtaaacttctcaatatttgttctagcccaaccacggtgacaaagctcccttgcccaaagatcgtgagcctagacaaaggtggataagaaatatgaagtctaaagctatagaatatagcagttagtgaagtaaattaaacatgcccctcgcctgcatgctgatcagagtgttgaaactgaagacgacattggcaaagtgactcagacccacagcacagatttgatcaagggcacagctcataaaaatagcaacaatttcgaattctcctatccaacgtttaggaaacaatccaatggcaagaaatgagaggagttcaatgccaacagtttgacctgtgggcaatcaacctataagtcctcaa

SEQ ID NO: 6275 - DNA, 4344 bp, Homo sapiens
gtgaccctgccgtgatgggcggggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccatcaacctcatacgtatctacctggtctctgatcgaagctaccgtaatgtgttcttgaggtcaacatgttttgtggaagtcactgtatttgcccctttatgtcaattacctattataaaccgagagaaatgggaaaattaaaaacctgttttgaattatttttaatgcagaactattttttcaagtgaaatcttatacagaagtctggtatatgaaacagataaaaatgaaccaatgagattgaagggaatgagtagcatgtaatcctgcccactcttcggagaatttgaggcaactttgtagagccttaggagttcagtttgtatgttactgggtaatttaaagcagaaattttaatctgactgcacttaagaatcatctgaagtgtttgtattggttagtcttatttttaatactgatgtcctggtctctctcccctcaaaaaaactctgctgctgggaccaagcacatagatgctttttaaaaagctcccgaaaatgactctaatatgcagccaggattgaaaataactaccctacacagcatttttcctgattctgagcactcagcttttcattgattttccctagggcaagtccttcatcttattctgggtccttgtgttttctttctgaacctacaatttctccataggtcccatggttttcaaaatttctcattttccattttctgtccttttatattacctacttgaaaaccacagtcatctttcaaaacaaaacactgcctgtttcttaggtctttattgtgggcttgttattcctcaatacaaatttacataaaataataacaattaagacatgggccttggtgtcagaattattttatatctttcttattaactctgcagcttaccagctctggataagttaaaggacagctatagtcttactacatagaatcattataaggaattggtggagtgatccttataaagtgtttgcatggtacctagcacagagaaagtgcttgaagttgttaactgttatggttacaaaatatgtaaataatttttattgtccaattttctctcttcatatacactaaattgttctaattcttgaaccacagtaacaacgtgtgaatgacttatgcattcagtgtgtccactcaactactatttattaagtacctgttatggtctatgaaaggaactggcaagacagtcattattccccttaaatattcccaagtgttagtggtcaaagtttctctctgctgaaaatgaaaagtaccccgtaggatggaggaaacagccatcttgagggctaaatctggtctaacataatatttgttgacctgttactacagtgttgccacatatgctttgttggttttttaatttagcccccaaacattttaaaaatcagatcatttcatgttaaaagaaatctagacttctagttctcttgcaaatgtgagctctgacaaacattgaaattatagagtagcaggggtagtgtgccctttatttggtgcatgtcttctgcaggttcccaagttctgctgttctctgttgttgcctcatcactgaggccaaatgtcagttgctgcttacatgcatttgaacagttgttattttttatagtgaaattaaaggtaaactgttttgatatccatgtttctaccaaaggtaagaaaacacaagccaaaaagacacagatttcaaaaaaaataagagaaagcataattctttatggaagtgaagaatagtctttttatctaagtatgccaaaaaaagcatgtataaaaaaatacaatttaagatgccattatgaaaaaactccaagtcagtgtttactaacatcttttcagttttaggaaggaggcaggttgtcttgcatctcattggatctccggtactacctatttcttgaaataccataagtgctaatatatacttgcaatagataaacatgaggagtattacaaatacaagagatagcaggaactattttaatattaagagatatcaaatatgcacgctaggattaataaatgaaataattattttccttcttctacaatatttacttaatctggaggcagaaatacatgttgtctctcttcctgcttctccatcaaaatcccgaccaagtaatcaggatctttgagaatcacaataagaattacagcctcatgtttggattttttaaatttaaattttaaattactcctttccactgatatttattgagaaactgctatgctccaggtactgcgataaacactgggcaaatgttggagagctaaaaaggcatattcctcttataaagacattatttacttgtaacaaacaagtaaataaatgtattagtcaatatgtaagtaaacaaaaaaatggacaagcacaaattatattaagtactatgtaggaaaccaatagagtactgtaacagaataataaggtatatgggatgggggtgggaatctgttcagagatgatctacctgagaaggtaacatgtaggcagagatctgaatcgtgaggagtcagcctttcagagtaagtggagtaggcacttccaagagaaaagcatattcctggctatttgcctatcaatgtcatcttgaacaagggttagcaatctcctacctgtaccacagatgctatgtgccacctccatgctacctttgccaccaagagattcaatgtgatgcatgatttgaaggttcctcatcctgataccctgtggaaagtaaaatcagtgacaaataaaagcagatcattatctcaggtagagtctgctaaagatgatacttgcttgtcagtacatgagtatccaccctagtaaaaaaccacagaagaagtgggatttatcttcaatgttctctcacttccccttccaagtgcctctcctgccttctgatgctctttcccacaagttgcaggcaaataaagcatgtatattactctctttttatccagagttgctccttgtccttatatgaagtagattccagacctcacaattgtatatgcctacccttctactccaacccctcaaaaaaagaggaagaatgaaagaatgaacaagagaaaaggaaggaagagagggagagaggaaaggagggaaggatggtcctgaagatcacagttcggtgctgaaaaaagcatttctattaaacttcaagacagaatgaatgaccatagctaataatgtaccttaagcttttctagaatctttgtattaaaaaagttgattgttactaaatgtattttaatctcataaaattttaggaatttaaatgaagaatttcacaaagggtaagaaaaattatatattatatttataaatttgtcattatgattctcccattgtggaaaaaaaaacaaaatctcggtaccccaattcacaaagccaaaaggaagaaagtaagctgaacgctgagtcatgcaagaaactgctcgcttttgttcctaagctaatagctacagataaaaggtcagatatctccataggtaggtactctatgttcaccttatgtaaagtgccaatttattgagcgtaagaggattacctaattgactattccccagcctgctccttttctcttgcaacacatggagtcagcaatgggaccatatcctctctctttcccctccagcctgctttccccctttaaatactgaagccctcaaaatcatctttctaaaaaggtatgaaccatagattgttcctgtggatttgtgtttctttcttccgggcatatccttaagcttggcaaaataaaattctaaattgattga

SEQ ID NO: 6276 - DNA, 577 bp, Homo sapiens
gtcctagggtggccatgggcagacagaggtggctgggcgggcagtgcttggaccagtgccctaatttcattttctctgctcctcccacagaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctg

SEQ ID NO: 6277 - DNA, 759 bp, Homo sapiens
agagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagctgtaatcacatatggattcttttatatgggtcttggcatggactgaacaaagagaaaggcagcacagaaagattacataacatatacacagagtccggtgcccagcgaggatggggcccgagaagcggcaatggtcaggacttaatgcgaaaatccagtagaagctgacactcaccctggcccttctcggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaaatttttgactttggttttttgagtgccatccactgttagtgattgttacatgaaaatcgcaaagtcctatgtaagccataaggaataa

SEQ ID NO: 6278 - DNA, 381 bp, Homo sapiens
aaaaattcaaatataaaatatcatagaaagcatgaagtttgttcttttatttcctttgtttgattacatcttcttataggtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctat

SEQ ID NO: 6279 - DNA, 487 bp, Homo sapiens
gctcgtccgctccctcccccgcgccgtgcacgtcttggttcgggccgggcataaaaggcttcgcggcccagggctcacttggcgctgagaacgcgggtccacgcgtgtgatcgtccgtgcgtctagcctttgcccacgcagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtg

SEQ ID NO: 6280 - DNA, 543 bp, Homo sapiens
acttgttaataacttgatgcctgagtattattaataattcagtacagatgaaataattgaaatgttacattatctttgcttttgtagactgtcatgtttaagtgaggatacataataaatcatttttattttaaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggtaagagcaaaaaatacaagttccttttacctaggagtaaagtacagaaatagtttgggaactttagaagatgattatctgtttagcaaccatggttttatttggtgtacctac

SEQ ID NO: 6281 - DNA, 544 bp, Homo sapiens
aaacacgcagggagggcaccccgagtgtcgccgctgagggcgtttctctaagcgcttctctgagacctgctgctgaaggccccacccgacacctggcgggggctgggctgcgggccttggggcggtgtcccctgtgaatgttcaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaa

SEQ ID NO: 6282 - DNA, 2254 bp, Homo sapiens
ttggccccactgtgcaccacacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaagagggactggaaccatctcagaagccatgcccctcaggctggaacttgccctgtctcctcgcagatgagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaa

SEQ ID NO: 6283 - DNA, 1098 bp, Homo sapiens
catttggagaatgggagttttgatgtgatagtggctgtcctaccactgcattcagcagataatcagaagacaaagatggaatgcatacattgcacatcattgttatgttttgataactgtttttaagtcttctttttctccctgtagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatggtaagaacaggtctctatcctcactctgtgacacaagaagattttctccatttgacttcctaccacccctctttttcttgccttgattcatgtacagattgagagtgaaatcataggaagtacattatcttattagtcactctcacaaacgattcttggcaacaaggatgacatgcagaaaatcttttgaacaaaaacaaatatagttataaaactatctggactgtcatttctattttgtatcctgttcaaatgtataaaaatgtattaccacagtgagcatccagagctgcaaccagtacatttgggatgtatttgcaaatacagttttttttaaattgttctgttttagaagtgatgagagcctatttacaacagctaaggcaagagactggactgagactttgtgagaaagttttcgaccctcagaatgataaacccagcaagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggttatcaagggtgatttgaaattttctgcagcattaaagctggcgcttaataagaataagtaataataaagaaatttct

SEQ ID NO: 6284 - DNA, 559 bp, Homo sapiens
attttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaa

SEQ ID NO: 6285 - DNA, 276 bp, Homo sapiens
atgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctatgatgagcatgtatcctctcgatcacatacagaagaggattgcacggaggagctctttgacttcttgcatgcaaaggaccattgcgtggcccacaaactctttaacaacttgaaataa

SEQ ID NO: 6286 - DNA, 1241 bp, Homo sapiens
atggctgaaaatgatgataatgaaaagatggctgccctggaggccaaaatctgtcatcaaattgagtattattttggagacttcaatttgccaggagacaagtttttaagggaacagataaaactggacgaaggctgggtatctttggagataatgataaaattcaacaggttgaaccatctaacaacagactttaatgtaattgtggaagcattgagcaaatccaaggcagaactcatgaaaatcagtgaagataaaactaaaatcagaaggtcttcaagcaaacccctacctgaagtgactgatgagtataaaaatgatgtaaagaaacagatctgtttatattaaaggcttccgaactgatgcaactcttgatgacataaaagaatgattagaagataaagatcaagtactaaatattcagatgagaagaacattgcataaaatatttaagggatcagtttttgttgtgtttgatagcattgaatctgctaagaagtttgtagagacccctggccagaagtacagacacaggcctgctaatacttttcaaagatgattactttgccaaaaaaataatattaataaaaaaaaagaaagaagaagaaagaaaacaaaataaagtggaagctaaattaagagctaaacaagagcaagaagcaaatcaaaagttagaagaagatgctgaaatgaaatctctagaagagaagattggatgcttgctgaagttttcaggtgatttagatgatcagacctgtagagaagatttacacatccttttctcaagtcatggtgaaataaaatggatagacttcatcagaggagcaaaagaggggataattctatttaaagaaaaagacaaggaagcgttgggtaaagccaaagatgtaaataatggtaatctacaattacagagcaaagaagtgacttgggaagtactagaaggagaggtggaaagagaagcactgaaaaaaataacagaagaccaacaagaatccctaaacatatggaagtcaaaaggacacagatttaaaggaaaaggaaagggtaataaagctgcccatcctaggtctggtaaagaaaaagtacagtttcagggcaagaaaatgaaatttgctaatgatgatgaacatgatgaaaatggtgcaactggacctatgaaaagatcaggagaagaaacagacaaagaagaacctgtgtccaaacaacagaaaagagaaaatggtgctggagacgagtag

SEQ ID NO: 6287 - DNA, 4279 bp, Homo sapiens
ttttcatgaattaagtaattgccacctaaaaaataacagaagagagtatgaaaacaaaaaaaaatccatgtcttttaaaatgtcttttaccatgttgcttcttggcaagtatcttataaatattccaagtcagatgttaaaattttttaaagcagctttatatttccatagtgtaatattagtttgggatttattacagggctttaatgtctgtctttacttgtctagaagtagcttcactggctcctaactactgccctggggcagattcagatgaaatgtggtatgtagccacacccaatactgttggcatactttcattgaatctattcccatggaagaaacccagttgcaatttcagtattatttcatcaaagaggccaggccagagctatcataactgctttcatgtcgtgtttcctttttattatatcatgttttatatcatatgtttgctttctacatactacatacacaattgcttgtgcttatataaatttataatgcttttgaataaacaaaacaataaatagtgatgggatcattttatacggatgtaatattttctgaagagccaaacaaattaaataagtaactttactccaaattttaatgagctattaaattttatttaaatcacttttcctttctacccaaaagtaatcatcttaagtgtttttccagtgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacaggtaagatctcttatctctcccttaaatgctctcctgatgaatcataaggttgttttactcagataatcactgtcaaattgctgatccagtacagtccaaaaaagattaatcagattattctgctgtttttatatacgttaaaattggcatgaagaaagtgtaaatttcaaaattatttaaatgctttcaattttctgtgatctatttctcctctaaatacaaatatttgttttgcaacctgacactttggggctctaagttttgctatgttaattaatggttaaatagtctcataggagagtaacctggattttaagaaactcctttgcagaagattaatatggccaaaagctgcccctttgctttgatagctgaaagttgatggaccatgtaattgtgattccatccccattcaaagtggaaatagatcctttctgcataaagcactctactgtcccaggcccactgatttgtagtcataaagaagtaaagttgactaaaccgatttcttttttttggtttatatttcaagcccatatccttgaaaacattgccatattttgagatcattaactagatgaataggaagtttagaatatgaatcttgttttatttccagaaaggcaacatttttaatgtaaaaatatttcctatagcttatatagtttatttaccagttattacccattaatgttcagcaaattagtacataatcttagtactgtcaattctgttcttaggatatttgtttctttgtcaaagggatattgtccatgtcatgaaatattgacaatatgataaaaatgtttgctaaattagaaaaggtgatgaatttggaggaaggggaattggctgcacctgtttctgatatgttcagaagcttaatgaatataatattctaatttaaataaactgtttgattgagaaaagaggtagccacattattgtttagaaatgatagactgttattgacttttggtgtagctgggaagctggagaagaggtagtatgtagtttgcttttgatttcaaaatgccacctcttctgattccagatacaattatcttttggcacatttcctaattagcattaggttcttataaatgaaattttattttacacacagtttttaatggaacttacttttgaacatcacgaaagttatctctagcccttttcatgccttaggtgctgataagcattccgtttatcataagctatgtcattagtctcagcttcctagtgggaagtaaaactcatagcaattctctcagtcatccatgatatatagctaggtggggccagatgatttgaaaattaacatattgttcattttaggtgctttgttttcattttaagttgtttctgcatctagtttgaagctgcttggcataaagatgagcctttctgatagaagtgtgtgagaacatacattgtagagttgcttgatggcatgcactttatcctcattgccactttatcttagtacctcattttgttcctggcattacctgtttcccatcctcttccccctttcctactaggattaaggtcagtaattgataggaagagtatccatacttctattctaataaactgtgtcttttgtagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtaagtcttactcacctttcgttttgttcattaaaaatgagatcattattcaagagaaatatggagccttagcatcacaaaaagagtcaacctcatacagaatggttacttcagaaaagtttatgaatattttcaccctgacttacagaactagtctactcttgaggaaatgttttaaactgtgtttttaatatgtaatataaaattgtttaatcacttcctgcatgttcaattgactctacttaacctttaagaacagtgagaagaaagatcttggctatatcatagaagcaacgtactcattatattttttgattgaccattgcattttgaatttgtagtccaattttaaagggctaccttattgaaaaaaacaacagcatccttgatagaaaatttatttggcctccacttagtcacgtgcttaactggaatggagaggaataatagtgcctactaaagtagagaaagaaacaagtgaaaatcactaatattagatgaggtacagcagtgcctcatgattaactttttctatttgttatagcccttagaaagtgtttttttcagtggggccatctgataggcaacattgcagctttttactcattggttttgtctctcctcagagttttggaatagtgactgttcagctttgagtggttcatggtggtggggtaatagatctcttagtgctcatttgtccatcagcagaaggtatgaagttgcactatctacatcctcaccaaggaatgctgtcgttcacacagccagaaaataagatgtttgtctggtagctaaccaagcttcttggaagacagacctcttgaaagttaatgtttcagttacaaatcactaccagattttcttacatccatgctgatcctaaaatactgaggacatgggtttctaaatatgtatcatttcaaatgttgcatttattgtatgttctaaagtagaagtctacaaattataatgtaactaactcatagccattatttctaaccagtaattaaattcttttggtttttgtctaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgc

SEQ ID NO: 6288 - DNA, 2682 bp, Homo sapiens
tccgaaatcaaccaattaaagcccaaatcgtataatagtttctctctaactcctcccactgagatgacccatagtaccccattccttgctgcaatgtaattatatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccgtacagatgagaaagctgagactcagggccagcaacccgggtcccagcggagcgcccggcacacgccgacacttcagcaccagtggcggtggccaccactgtgggcggagatggctgcgacgcgtgcgcagtctagtgcttttttccagatctcgatcccaaactccctcctgccagaatctggacccgaatccacccattgcccgttttccgctgccgctggagagaatctctgaggtccccaggagagcctgcctgcacggaagagacgcctcctcggtatggccgcccccggagaggagcgattaagtgcagacctccttgttgctcttgagcctgagcggcttcagggagccatgtttgttactggcgggcgccgacctcactgagcatgtgcagccctggccgggcggcctcaaagttctgacatcacagggcggttcctgaagtggacgtagttgtaagagctagttattttagacaatgcctctgggatcagggactctaatctggaaataggtagtcggagaggtcggtgatgcagtctctggatcagagacctgagctatatggggttagagaggggccctgggcaggcgagtctctggggagtgtggtgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgtttttcgcctctcattatttaaataatttgaagttttccccaataactagtgtcttagaagtcatgaaaatttcagaaaatgacaggtcttctgagttcgtgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgggaatggcaggcattcagatctccaagaatagaggattaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcgtggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaagagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcgtaattaaccacccctaagcttaacttactcatggttctgcagggtgactgctctccatgtttctaggtggttctgcatggggcctctcacatgtgctacagtcaaacattagccggggccacagtcatctgaaactcacttacatggctgacaatagatgttggctgttgcctggagaagacatatgtggcgtggtggaatggaatggtgactagattcaagaaagagcttcccaggaggaaggctaccaagagaccgaagtagaggcttcagtttctt

SEQ ID NO: 6289 - DNA, 474 bp, Homo sapiens
aggatgggcctcgggatggcggggaagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagacca

SEQ ID NO: 6290 - DNA, 685 bp, Homo sapiens; identical to SEQ ID NO: 2570

SEQ ID NO: 6291 - DNA, 2022 bp, Homo sapiens
tttgcgctggaggagagtgaaagagatgggtgtgtgggagtgggggaagctgagctccaggcagacagcacagagccgccttgtccaacccagccaggtgccatggcaaccaacaaaggccccattgtcccgtgtctgctgggccttcctgaggctctggggtcagagctttggggaagtgttttgtttgtagatttgggatgtggagggggactgggctacaacacccacccaagagtgtcagaatctgacatcccctgagagaccacccaagcccaaccgtccactgtatagatgaggaaactggaacttctagaggggacgagaagaatgaattagcctaacttagtgctccatccatgtgactggggcaggggaggggtcacttttgtcttcctgagggagacaagagatctctcctttcatgagagacttgggcttgaggctgggttggagaggaaagtctaaaatgtgggggcccaattcacccacccccaaactccctcctcatggtctggtgggatttgctttgcagagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctcta

SEQ ID NO: 6292 - DNA, 580 bp, Homo sapiens
gcattttccccgattgtcagtgaggctcggcacgcagacaccccgctcgagccgcagcagtcgctctactcccgggatcagcacctttccgccagggctgctctcagttagcgatgtcaggccagagctcctcttgcagatgcacctttaatttggcctccctcagatgactggaatcttctgcggcttgtccatagtgtgaataaaaactaaatcacatctataattctactgaactggtcacacagacgctgccatatatgtcacagtacactgaaaaggagccagcagcaatggaccaagaatctggtaaggctgtctggcccaaaccagcaggagggtatcagacaattacaggcaggagatatggaagaagacatgcttatgtcagttttaaaccatgtatgaccagacatgaaagaagcttaggtcgggctggtgatgactatgaagtgttggaactagatgatgttccaaaggaaaattcctcaggttccagtcctttggatcaagttgattcttctttacccagtgaacctatatttgaaaaaagtgaaacagaaattcccacttgtggttc

SEQ ID NO: 6293 - DNA, 1556 bp, Homo sapiens
aaatgtctttgaaaaattttaaattaatatcatatctcaagctcagaatttatttaaattgatacaaacaacactatttagtttcacgatggaggtagtagaaagataggattttgtatctaaacatactggtttcttatcctgattctcccatttacccactagctatgccagctaaggaaacctgagccttcatttctttaactgtgaagaagacaactttggcctcagcagggttgaggattaaatgatacaatgtatgtaaatatattctttaaccaaggggtcagcaaactttctgtaaaaggtcaaatggtaaatatttttggttttgtagatcacatggtctctgtctcaaccactcagttttgccattgtggtatgaaagcctgagtagagaatagctgggctccagtgaaacttaacttacaacaaaaggcagcaagctggatttgacctgagggctgtagtttgcccacactttactctaacctataaagctctgtgtaaatattgagtaattgtcatgactttctctcttcaggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttata

SEQ ID NO: 6294 - DNA, 390 bp, Homo sapiens
gcaggaagagtagtatgtgacagctatttgtctttctgcctcagatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 6295 - DNA, 2979 bp, Homo sapiens
ccggtttgggtgtggccgcatggcgtgctgtggtgcaggtggccgaagggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccaggtccttgacaggcgtgcatctgggccagatccatggcaataaccttcaggttgaggctagagggcttcagatgggcagcttcgaatgacaggagcaaggcacaagaggccggaaagggagggtgacattttcagcatctataagatcaactttagaaacatttgggggttgacaaattcccatcaagctctgtggatcttgtacaactgctcaccaccggcttctcatcagcacatgattggtgcagggttctgaggatgattttgagatgttccctgatgtggtcttgtgaggagatttcatgacagatggcaggaagcttcgtggagagatttctgaagacactcctgagctcccaacaccgggcaactctcttccagaggatagtggggtggagggtagaagagaggcaaagtcaggtttgtccttcggatccccttcattctccttttgccaccgtaaaccaacttttgcttacagttagacaccagttttcggcagatgaaatccctctgatttcaggcattttgtcaattaagctgctcagcaacaataggataaacttatgaaaagaaaggagtagcagtcccacagacaaagcatccagcccctgcactgagacagtatagggaagggacttggtcctggcagacaggacagataatcaacatcctagtgggccttacacatgtgggcatattcttttccataccttcttgtctgttttaacaagctaaccccagtcacagtagcagagagagggtccatcctaacttagctgaccaggctggattcctaatcataaaaccaaaaaaggaagaacctaaccatttctctctttcagctatgtgttccaagattactgaagcaggattctggccttcctgataagaacatgaccagatccagctggtttgcaacaagatgaacttcagtgctgagctttcaccaagtttttctcactacaatctcattgtaatactaaaatctccacccaagatggaggttatctgccattttctgtacatgtgttaccagaaaggggtcctgatccagaccccaaaagagggttcttggatctcacgcaacaaagagttcggggcgagtccatagagtaaagtgaaagcaagttcatcaagaaagcaaaggaataaagaatgcctactccataggcagagcagtggctttggctgctcagctgcttgtacttgttacttcttgagtatatgctaaacaagggattgattactccttgtttagcagttttctgggaaaggagtgggcaattcccagaactgagggttcctcccctttttagaccatatagggtgacttcctgatgttgccatggcatttgtaaactgtcatggcgctagtgggagtgtcttttagcatgctaatgcatgagcagtgaggatgacccgaggtcatttttgttaccatcttggttttggtgggttttggctggttttggccggcttctttaccacttctttttatcagcaaggtctttgtgacctgtacttagtgccgacttcctgtctcatcctgtgagtaagaatgcctaatctctcaggaatgcagcccagtaggtctcaaccttattttacccagcccccattcaagatggagtgactctggttcaaatgcctctgacacatgtgcctcatgtttgggcatgagacctcactgtgtaggtgcagagaagaccctgcctaaacattgcctacacgttgctcctttttcctgcctcaacttccttaaaatgacaagagcagagcccttttgggagctaacatcaggactccttttctgtactctgctccgttgtgctgctagagccacaagcctattaaactttgcctgaaataaattcctatttgcgctggtgttaatttttacttatgagtgagccaagaactcaggccagagttgcggtaacaccaccagaagaggtctccgcttgtcagacttgagggatatcatcaatgagcctctgagctaatggtgtaaaccaaaaataaaattctaagccccccgccagccaaaccatctgaatggacttcctcctcagccagggtgctcttaaaatttaacctgagagactggttcaggtcatgatgggaagtaggggttggacatgcctcattatacctctccagcattaacatcaacataaaccctaagtctaagaaatttttacaacctattctctctgaagctgactaccttggaggcttcatctgtttcataaaattttggtctccacaacctcttacttcaacccagatatttcctttctattgatcccaggtctttagataaacttaaccaattgtcaaccaaaaaatttttaaatctgcctataaactggaagctccgcactccgctcccctcccctccccgcccttcgagttgtcctgcctttctggacagaaccaatgtatttcttaaatgtacttgaagtctcatgtctccctaaaatgtataaaacccagctgctccctgaccaccttgggtacatgttttcagggtctcctgagggctgtgtcatgggtta

SEQ ID NO: 6296 - DNA, 1575 bp, Homo sapiens
ggattttgcttccgggtcgtaggcgctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataa

SEQ ID NO: 6297 - DNA, 615 bp, Homo sapiens
attatctgcaagagtcaaaacaaatcgtctagatcccagaatgccatctgggagcatgtcattttcaaatggcaaagttgtcttcctactaattttcactgtaaccagcggaggtaaatgtaggtacttttgaaagctgcattaactctttcagccacagggtgtcatttagttcaataaagtagtttttatgcaatttaataattgcctctgtgcacccaccagcatccctgtggcctgaaagagttaatgcatttttttcagaagtactgaagatacatctccctgtgaagtgaaatggaatatttgatggctgatatttttaatagcacaatgtaaaggaaagagcttctataagcagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaaca

SEQ ID NO: 6298 - DNA, 2346 bp, Homo sapiens
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttgacggagtcggtttgtcactcaggctggactgcagtgctcgttgcaacctccgcctgccgggttcaagcgattctcgtgcctcagcctctccagcagctgggattacaggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaa

SEQ ID NO: 6299 - DNA, 1087 bp, Homo sapiens
tttaaagacttcatttttggtcagcataagttttctttaaatatttttctgtttccagttggacttcactttgaggcttaacatatcaaagtgagtataaagttctacaatttagtcattgtggattttatgtcatttatgatgaaaatggaaatgtgtagttaagaaaattttcttcttctgtaacatctaactcttcatcctcatcatcttctgcttgttgatcctttcttagtcgacaagtggatacctgtcttgttccagatacacacttagctgacagtgatctctgaagaggtgactttgaattcgctcttacagtatctaaacaagatgaataatctggtgcatacagagaatttcggaaaacctctaaatcttcatcttcatcaatgttttgtatattccggtaggcagcagtgtagacctctaaagctttgccgtgaaataacatttcgattgtgataaattcagaaaatatagtctttatatccttcattttctgcctttcaaagttgttaatagtttcctccagatgacgacttgttcggctagcatccattgcagttctctgtaattccgtttctgcctgtgaaataacatgtcgatcagatgggtttcgctgacgtgttctttctaactgagttaattgcttagcttctcgattccttgctgtgaatgttgctttgaggtcatcccgtttcattttcacaatggtcccataagctttcaagggttcaactactttgggttcaactactttggcttcaagtctttcaacctctgcttgtcgataatcctgaagtttggcaaactcatcatcaaagttcatcaggcccagctttaaatgtggggtctctgtagcagcatacgcattgatttcattcaccaggtggtctgctttgtctctcagcctggcagttttccgcacataggcagcgaagatttggcacagttctccaaaatgcttctccacatttgagacagctgtttgcagttgtttcgtttgagcgttccgattttccagggtgcacctcatcatgctgcctcgcgcacggcaggggaccttgcgggggcccagtatttg

SEQ ID NO: 6300 - DNA, 3179 bp, Homo sapiens
gcacagcggcggcgcaggcgcggagaggggcacagcggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatg

SEQ ID NO: 6301 - DNA, 832 bp, Homo sapiens
gtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccgttctttttgaaaagttgtatatttcccttttcagctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaa

SEQ ID NO: 6302 - DNA, 1431 bp, Homo sapiens
cttctgcttagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccatggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaact

SEQ ID NO: 6303 - DNA, 2877 bp, Homo sapiens
gccccggtctcacgcatgcgcagagggccgatccagttcttttcggctggaatggggaatttgtgaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgacaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaacaaaaatttaatgaatttctgttagaggccaggaactattctagagacatttgggatacaaaagtgaacaaaacaggtaattccctagtagagtttatatcctggcaaggagaaattgacaataaacctaataaataaggtttataatatttagaagctattaagtgctatggaaagagtagtaagaaggaaggtcagggaagtactggggaaccaaaccatgaagggttctgtagaccattattgggcctctggcttttgtcagtggactagagaacagttgaagggtttaagcgaaggagagaaatgatctgagctaggttttaaaagacactctggtcactattttaaattcttagggtaagtctgaattaaatgttactttcccctcactgggcatggtggctcagacctgtaatccccgcactttggcaggccatggcagaaggctctgttgagcccaggagttcaagaccatcctgggcaacatagtgagaccttatttctactaaaaatattttaaaaataagtcaggtgtggtggtgcacacctatagtcccagctactcaggaggctgtggcaggagggtcgcttgacctcaggagtttgaagttgcagtcatctatgattgcaccactgcagtccagcctgagcaacagagtgaaaccctgtctcgagaaaattaaatgttacttccctaaaaaaaccttttctaaccaccctagggtaaatcctccattattcctttatttctttgttttccttgtagtatataatttgtaataattttgattactgattgtcattctgccaccctggagtatataatttttaattatctgattactgttattcttccatagtaggggaggtgatatccatttgcctgatacatagtatgtgttcaatacacatttgctaaagaataaatgaatcaataatacctaacatctctaatttgcagtcattcccaagagtaattattaaatatgtggcaaatttctttgcctttttacttttaaaaatctaattttgacataactgctgtaaccatccagaaacggcattgatgttgcttcacgttgctgatgcttaagcaatgtatattgtgtaatatacaatgtagtcttcaaactaatttcaacttctgcctttctgtgtactcccttatcccactgggtgatattatttggcatggtcattgtcattaaaatcatacaggatagtaattcctttccatctgctaccatgcctagccttatttaatttttcagattttctgttctattgaaggtaattgattttttctttttttttaatgcttgaaataaagtgttgaaaaacaa

SEQ ID NO: 6304 - DNA, 1095 bp, Homo sapiens
aactacgagtcccgacgtgccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgta

SEQ ID NO: 6305 - DNA, 2227 bp, Homo sapiens
taagttcaagaacaagcagggaaggcagagcaagatggctgaatagaaccctccagcatttgtcccccaagcaagaacaccaacttgaacaactatccacacaagaaagcactttcagaagaactaaaactcaggacttcattgacttaactagagagatcagaccaaggacaaaagatcgcagtggactgtgtgattgacctgacaagagctgagggagaaaatagacctattgccactcttgacttaactttagaacctgtcactccttcccagagggagccaaccagtcttcagacatgtgccagcctctctggcaaagcggtgatggaagggcaggtggacagaagctctcagcctacagcacggagactcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtagcagcagcagcagcaatcaaaaagtacccttgccatgcccacagcaagatgtgtctcgcccaccacaagccttgccttgcccactgagagcctcaccttgtccaccacgagccttgtcatgcccatcacaaaccatgcagtgcaaactaccagctctaactcaaccacctcaagaagtgccatgccctcggcagaatatcccaagcccacctcaagactcgttatggcatcctcaacactcaccaagcccacctcaagactctctgggcctacctcaagatgtgccaggcccgcctcaaagcatattacatccacaagatgtggcatacctgcaagacatgccacagtcaccaggagatgtgccacggtcaccaggaaccatgccaccatcaccagatgtgccacagtcaacaggagacatgctagggtcaccaggagatgtgccacagtcaccaagttatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaactgtgacatgcctatggatatctcagctgcgtcccctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgacctccggttcatcatctgttctttcagacgctaataccggataaagacacgagagaacaagggtcaaaaattagaacccatccctcatcgaagactaagaatggtaacaaataccattgaagagaattttcccctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacggctacatccagccaatgccaagacagtggagtgggactggaaactgctcacctatgtcatggaggaagaggtaacaacaattataagattatatcttctgtaggggaagttttaactataaagaaaagtgataccaggtgccatggctcacacctgtaatcccagcattttcagaggccgaggcagtaggacagtttgagcccaggagtttaaggccagcctgggcaacaaagtgagaccctgtctctacaaaaataaaaataaaatatttagccaggcatagtgatgcatgcctgtggtcccagctacacagaaggctgaggcaggaggattgcttgagcctaggaggtcaaggctatagtgatccatgatcacaacactgtactccagcctcggtgacagagcaagaccctgtcttaaaagaaaaaagaaaagtgacagtaaatctggtaataaagtctacaccattattccctcctgatactcc

SEQ ID NO: 6306 - DNA, 1315 bp, Homo sapiens
gcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccagga

SEQ ID NO: 6307 - DNA, 3078 bp, Homo sapiens
cagatgttcccaggacgcgagctaagtctgcccggccggcgcgcgccgcttccgctttggtgggaaggacctcccttcccccttatagaaacactttctccaggccgggccgggcttggtaaacctcagccgtgcctgggtagaggacgccgggctgggccgagcgggggtggaatgagggcgtctagaacagagaaaactaagtaggatggggtcgtccccccagtaatctggaaaacagttacagcaacaggctcctctcatcagacggcagtgctggtcgtttcctcactggtttgcggggaaggctgggcagaaaaaggatgcaaccttgttctcaaccacttgctatctcgtgattcagggattggatgagtctctatggtttgttttgccctgaagagcagaaggcttctgtcccaactggtgttgccaaagcaacatattaattccatgccatgatcctgggtcaagatctgcacaatctgattgggcatgtcacctcggatggcaagggagtggaagtggtcaaaatcatggagtcccagctttcggagacgccttgcagctgcccggtaacacttccagggttggggctccacaaggaggtagtggcagagggaggaaagatgggccaggaactcccataggccatggtctccatgattcagatgaatccacatggttattgacatgcagaagccaatgtcaaaaactgaacgtccaaattggcttaagaaagagctcaagagaaccttccgggtcctttgattcatgaagtccagggtgataaaagtcaaggcatcaggaaaaggacattctttttcggctcgcttcaccaggactggatctatgtcgcagcagaggagacggaattctcttgaggcatctgagcaggtttccccgtcaggtagggagaggaagtgtttgtatagagccacactcagatcctagaggaatccaaaacagctttgtcactgcagttctcaatcagtgaatggaagagaaatctgtatcattctcccactgagaatgccacttacctctggctgtataggatgtgaggttcctaaaccataacctaaagaggttgtgcaaaaattttctacagagtaggctctcagtgccctccaggggtcacatgctgtaatgcatcatccccatattttcctgacactgatgatagattgggttgtatagctgaaagttacagccaaatggatgcagcaaaggaacctacagcagtatttcccagcttaagtaatatgctgataaactcactctttttctgggtatctcaagaccccagggcggaagaaaggggtccagaggcataaccagtgtctcttaccaggaaagtgaggaatacagcaagcacaatcttacaaaaacctgcttctcagacccgcggtgggggaagtctggattccaaagtcctcattcagccttcactaaagcttcaattttactgtcttaggattcaccacctccttctgagacattctgcttctataaccatcattgctaaaagtcactgctaacaaccttctagacaagtccaatgatttgtgatttttaccacattagcaccttttttactcttaagtcaccatctcctttctctaactttgaattctttttttttttgagacaaagtctggttctgtcggccaggctggagtgcaatggcgtgatctcagcaacctctgcctcccaggttcaagcgattctcctgcctcagcctcctaagtagctgggattacaggcatgcatcaccacactcagctaatttttgtatttttattagagacagggtttcaccatgttggccaggctggtctttaactgacctcaagtgatccacctgcctcggcctcccaaagtgctgggactataggaatgagccactgcacctggcctctttgatttctataaccattataactaactcaaatttgtgtttttccacatagtattttcaaggcatttttctgtttactactttgtttgcttggtgtaacaagcatgtgaggaaaatatttatttatgccttttctgcaggtgaagaaaatgcacaatggaaaccacccagatgtccagtgatagtggcatggacaaataaatgtggtataatcatgaagatagaatactaaatagcagttaaaaaatgaaggcacccagcttggtgcacaacatggatgattctcacaaatacataatgttgagaaaaaaagcaagccataacagaaaatatatgaaaagcatccatttacatgaagctcaaaaatgggtgaaattaaagtacatcattcagggaagaaaaacagtacactataaagaaaagcaaggaaacaacagaaggctagttgttacctctgggtagagatagaggtttatgaacaggaaaaggcatataggggaagttgtggggtgctgaaaatgtttattatttatttatttatttatttttgagacaggatcttactctgtttcccaggctggagtacagtggtgtgatcactgcaaccttgacttcccaggctccagagatcctcctacttcagccttatgagtagctggaaccacaggtgcacaccaccatgcccagctaatttttgtatttttggtagggatgagattttgccatgttgcccaggctgatctcaaactcccgagctcaagcaatccaccagcgtcagtctctgaaaatgctgggattacagcgtcagccactgcacccagcagttttttgggttttttgttgttgttttatttgagacagggtctcacttcgtcacccaggctggggtatgtggcacaatcaaggctcactgcagcctcgacctcctgggttcaagcgatcctcctccctcagctctctaagtagctgggactacagatgcccaccaccacacctggctaattttttttagagatggggttttgccatgttgcccaggctgggaaaggagtttttaaaattgaaaaaaaaaagcacccataaattatggtacatctatccaatgaaacattaggaagctgctaaaaaaagaatgtggtgatataaataatctcaga

SEQ ID NO: 6308 - DNA, 1280 bp, Homo sapiens; identical to SEQ ID NO: 2304

SEQ ID NO: 6309 - DNA, 838 bp, Homo sapiens
agttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcaggtaaagaaagatgtaactgtttggagaaaaccctcagaagaatttaatggatatctaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctc

SEQ ID NO: 6310 - DNA, 772 bp, Homo sapiens
agtcatttcaagtatccatgtccattgcagctgctctggaactcacaggaagatctcagtttttgcaaactcatggaagaatcacctggcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctca

SEQ ID NO: 6311 - DNA, 923 bp, Homo sapiens
tatgagggatagttatgtgagaaaattaattagataatgtctaaaacatacatgtcgacaacaataaaaaatactgtgctttattaagttaggggaattggcttaaaactgcaaaatgaatgttatagaaatttagtgagccaacaaatagtttttaaatacttttctcttccttaagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttt

SEQ ID NO: 6312 - DNA, 1280 bp, Homo sapiens
gcaccactctgggcctgctgcccacactgactgcggggtccgggagagcgggatgctggccggccgcgcctggcttcttggaaagagcaggaaggagcgcgagaatgcagttccgcggcaggtgctcatcccagcagcttcgggctctcggttgtggtttttacacctatgacaaatgacatggccaaacacaccataatgtctgaaggtacaggtagccctaagcgcctgctcgtcacggaagagactgtcttgagagcacagaaacctctgtagaggagcaggatgcaaccgacaggctgtggccggacagctgctgcccagcacatggagcctgcacgcgcacggtttggccaaagaagcccccatactcccggtgaaaaagatggagtcttgctctgttgcccaggctggagtacaatgatgtgttctcagctcactgcaacctccctctcccaggttcaagtgatctcctgcctcagcctctggagtagctgggattacagatttccagaagctgttctgtcaataacaaagtctcaaagaaaaccacaaaaccaccaacactaagatcattcttgagtccaatttgaaaaactagggtcaagttctgcagaggcattgaaaggacaagaaaccaccctgatacccatcgtgtgagggaaaatgctctattcaccattcctcagcttctgcttctggtttcagagttctctctatattggagggtgttttaaagctagagtggtctttatccacttttattaacacatctgaatgtgaaggtcaagagaggaaagtgatatgtcctaagtcagagtagagtcaacaagaaaataagacaaacagcgactgagcccctggtgtatactgggcattggccagctactggggatatggagatgaagaaaacataacccttcttcaaggagcccaacctaccaaggtagacagacatatagacaaatagatacttgcatagaaaaaaagaggaaaaggggatcagtgtgacctgtgtaactaagtaccctataaaccctcctgcaacagatcatattgccctttatagtggggatggtaatcccatctgaattccacaggtactttgcagtcataccacacccatgtgtctgtcggtcctgactgtaccatttataaacagcttcactttcagcagttctcagccctcttaagctagggtcattgtcagtagggatactgcttcataagcaccagcagaacaccaaaggagaccatatgggtgaaagcaaccagcactg

SEQ ID NO: 6313 - DNA, 649 bp, Homo sapiens
tgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaaggtaaacaattagagaatatagttggatgtgagcatctaatgatgcccctgtgttttgattgcttgaaaagctttgactttaaaaacgtgtattatttctctgagaaaaaagttaactaatttttgtaatcttgtaaatcttcatatgtttggtagtttaagaacttagaggtgtactgtctgtgtttatacattgcatcctgtattaaagctaaatcttgagtaatgttaatattcattctggttaacaaattttttttttttgagacggagtctcgctctgtcccccaggctggagtgcagtggcgcgatctcgactcactgcaagctccacctccca

SEQ ID NO: 6314 - DNA, 2571 bp, Homo sapiens
cttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactg

SEQ ID NO: 6315 - DNA, 232 bp, Homo sapiens
gtctgagtgctccaggatctggctggctgtgaggtcctcctcctcggatgattcatcggagtcctcatggtgcattttattcaggctaggagtgcttcctgacagttggcgctcctccagaatctgcatatcacacttatccaggctgtccagagaacgtctgcgcactccccagttgaaattgtccatactctcaccctgaaggaccggatctgctcaacttgttttccag

SEQ ID NO: 6316 - DNA, 813 bp, Homo sapiens
acttacacttttttggaatggtgcctagcacatagtgagcgcggcattagccatttttctcctagagcgagcccttctctccttgtataatgactctcctgtctctgccggcttccttcctgtagggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctct

SEQ ID NO: 6317 - DNA, 821 bp, Homo sapiens
actcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggagcatggattggcttacacctgtaatacgttccagaatagctggatttcttttgttttcccatcggtgattttcatagagtagatgctcaatgacatataatgcagaaaggccaaaaatagaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcgggg

SEQ ID NO: 6318 - DNA, 1290 bp, Homo sapiens
gtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggtcccagaagaagatgtaaagaaattaagaacgacacttaggtacaaaatgatgtgtgttaagtgcctacagatccatattgtatacacagaatgttttttactctgattgttgccctgtagaaacttaaggtataaggttgacctgcttcaagaacgttagggaatcacatatattgttgatggctaattgttatataaatggtaatacataaaattagtccccagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctgtcagttcctgtctttactcataatgtattctcactctgccaatccctgagttctttcttgttctgtttttttttttaatttattctatagagcctattctgtctctccccccttcctatgtgaagtcttccctgactcaagtggtctcagttttccctgaactcttgttgacttcatcttccttaactgtcaaccatgcattgtcttccagcttgcttgtatatcttctttgtccatagccaaggctgatcagcataggacaatcaggacaatatgaatgatgctgaaatatgtgctaacagtcattttgctgactgttctggagactcccattccttttgaaaacaaagatggacttttcaaatgaagttatagttcagggactttgttttgaattattttgtaagacctgaactaataaaagccctatacagagagacattcggtagctattattattggttatctttaatgtgtacaatgctttgagcgtgatggctcaaaattactattcttagtatttataagttctactgactagattttgaatgtgtcatctcagttcatatagtatatattataaattgaatcaataaaagtaaggctcattaggagattatttgccatgattaatgattgtggaagaaagaaattcatattttttccacatatttcatcttattttaatagtaatgtccttaaactttactataaaaaaatataatgtc

SEQ ID NO: 6319 - DNA, 1706 bp, Homo sapiens
gttccatgcccttcaccccaccctcgccgacccgctgctgacatgcagcggtccctaagccgtcccccgactgcccagcctcttgggcatcctggggaagcgtgggcctcagagccaagcactgcccctcagaacgttccagagtgtccccagctcccccagagtaaacgcggagtcctgcagtgatgccctgcggcctcctgccagctctgtcccagccgttcatggctgtgcctacgactccacgaggccccctcacccccgacaggcttcacatttctctgtagcagcactcgccacatgcttggactggctgcctcttacttctgggcctcccatggtatagagtgtaagcgccagcaaggcgggagccccatgctcatgaggtgttgacccactgcccaccattactagctgtgagcgccagcaaggcaggagccccatgctcacaaggcgctgacccactgcccaccattactagctttgttgatggcatttcctgtgctggctgctgagagaatcatcaacacccacgtgcagatcctctgccctccctggcgctgtacctttgtgcaggtggagatcttccgccttcctcagtctcttctgctaaagaggcactggcactgacagcaagaggacctgctatgagaaccaaagggatggaagggcccggcaccactccttcccagtgcagctgtggagcagacgcagctgctgtccctttgtcatttacggggaggggattattgacgttgttactctgtaggttttaaggatttcaagtcatcagtgtcttccagctaaggtcagatgtgctgctgatgacccagagggcttgcagggtgacgtctctctgctgggggaggcctcggggtctttcctgtgctgctgggtggtgtctccctgtcctgtgacccagtgtgttttcttcataatgagcattcattgcatttgggacagtacagtggagattaccgctgctcccaagggtgggcccagtgagggtgttgctcccacctcagtccacatcagctctctccaaagtcttatctaaatagacggtgtcactagaactttttggttgtattgcctagtaattttttgtttttgttttttaaacagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctc

SEQ ID NO: 6320 - DNA, 1480 bp, Homo sapiens
gctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagaaggaagctatctgtgataatgctttgtggtgtatggattcatctcactgactgaaacctgagttttgattcaccaggttggaaacactctttttgtagaatgtatgaagagatatttctgaggcctgttgtgaaaaactgaggtttccacaagaaaaactggaaacaagttatctgagaaaatgctttatgatgggtgaattcatctcacaaaattaaaccttcgttttgattcaaaaggttggaaccactctattttaagaatctatgaagaaatatctttgtccctattgtacactatagtggacaactgaatacttcatgacaaaaactagaaacaagctagctgtgaaaatgctttgcaatgggtgaattcatctcactcagttaaaccttcgttttgattcaacaagggtgaaacactcttttggtagaatctacaaagaaacatttatgagccccttgaggactatagtgaaaaaatgaatctcctgcattaatatctagaaacaatctatttgtgaaaatgctgtgtgatgcatggatccatctcacagatttcaaactttattttgattcaacaggctggaaacactcttgttatagaagctacgaagggtcatttctgaacccattgaggccaatagtgaaaaactaaatatc

SEQ ID NO: 6321 - DNA, 761 bp, Homo sapiens
gtagaatccagccagtcagagagcaaatccttggcttcttccagcaacacctccacacagctgttgacttcctctcccgtgagtctggactgcacagctttctcaagtggctctgtggcaagctgcactgcgtgctgaatccgttcgagcatctgctttttatcgggatccgtggtctcatttaattttactgaaaatggcttcagggcggcctgaacatcctccaagagctgtgccgcttcaggcctcttctcccgatactgctcgaacaggtggttctgccgggccctcttgatgatcttgtcatcaatatccgtaatgttcatgcaataaaagacatcaaatttgaagtaatccttcaacactcttctcaagatatcaaaagagatgtaggacctggcgtgccccatgtgagatgcgtcatagacggttggcccacagcaataccacgtcacctttttcccatcttgaggtatgaacacttcctttgttaggaatgaaggaatgacgatcacaagaaatgcaagaaacactgcacaggattaccaaaaacagcaacaaacatcacagtgtggtttgtgtttagtgtaaacaattcaacagagaccattttgttttactgtgaaaagtcacagtctcagtgggagcccagtgagatgtacggcacctcccaccaactgagccctgggtgggtggggcctcttcctccctggggttctactcatctatggagggaggcgataaagggaatcaatgatttt

SEQ ID NO: 6322 - DNA, 570 bp, Homo sapiens
gctgacaggacccgagcttccgcgacaccagaaggtgacgccagggccgccctcatcctgcggagccaccggggaccggggcgagacgggggcggaaagggcctcgccctgagtcttcctcctgtcctgggcccagctgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaaggtgttggtatcaagatgatgctggccttataaaacgagtcgagaagtgttgcctctttttctgttccctggaagagtttatagggtgctcgagaggaagacctcgatgctgtggaagcgcagattggctgcaagcttcctgacgattatcgatgttcataccgaattcacaatggacaga

SEQ ID NO: 6323 - DNA, 1047 bp, Homo sapiens
gcggagtttgtggtgcccgtagtcacaccacacacacatttatgggatgtcagacacacggccagggccgcacaccctggaagcagcagtctttgtgcccacctccatcccaatggtccttgctgctcagagcataaatgtctgcccggcccagcatcccagagtcgaacaccctgacgagcaagtctatgccagggctacacacaggaagcccagggcctcccggatcccagggagcgcacgtgtatctgtgtgagagagacagccagccagcctccaggagcacacggcctggcacctgtgtgttacgtctgtgcgtggctgcatttgtatctgggggtgcctggcacaccccacgtgggtggcttctctgcatcaagacggggctatgagcctggagtggtgtctgagtgtctgaggaggtgtgggttcgtggccaggtatgtgtgtccatttgtgttcgccttgtgatgtgtgtctgttgtgtccaggtctccttgtgcgggaggcagcaccagggtgagccccccacccaccgttcgtcccagtgaggccacgggcctgagcatcagagtggggagcgcagccccgtggtgcgattgcgtcactcagcgggggcggcggcgtgggccaggcctatcatctgggcacatactccctgggcagccccgtccagttgtggtcacgcagggcttggtccaccgtccggatgtagccattgatcaagtctttcatctccggggtgaagggctcagggtcgtgggagcgccggccgcgccgccggaagctgccctccttgttgttctccacgcagagcagccgctcctcgctcacagacacgttgaggaaggccaccatctcccgtaacgtgggcaccaggctgcgccgcagctcctcgtagtgcaccaccagcagccgcttcccgtacttgagccagtccaggacgtgcgaggaccaccacgaggcgtagctgttgacaaagtccggccactctagagtcctcctataaagctaagtcagcgtgatgcctgatgggcaaatacgcat

SEQ ID NO: 6324 - DNA, 1687 bp, Homo sapiens
ttgaagtattgtgtttgggcttttacaacatgtgcctcactgtttcgcatctacagagagagtgccgctgagagaggagcctgagtggatccgtgcccagatctgcattctctgtcctcaccatgcccagctaattttttgtatttttagtagagacagggtttcaccatattggccaggctgatcttgaactcctgacctcaagtgatctgcccacctcagcctcccaaagtgctgggattacaggcatgagccaccgcgcccggccagcattgtatcttaaaggtagcctttcagttgtttggatgacagttgtctccactggacatctgcttcatgccaggccctctcctgggtgttggtgtgtccactcttccctccaaccaccatattcccttgaggccaggaatggacctaagggtgcctcaggcatgggaagacccgataccggcctctctggagctcgctggcttctggagttctgagttaaggaggtagttgaagagacccatgtatgacccccagatgccagtaaaactaatcatgtgcagggaaggtggtcacgtcaataagattttgaaagcaagattcatcaaaaaataggccagatttgcagtcccacatgaacctgcattgaaccctcattgactatccaggtatgtattactttaaaaaaataaaaactaacataaccttaaaacatattagcaaatttccctgacacactgaaagtaggatattattctaaaatttttcctttatgtatgtagctttttagaaaccctacaaatgtgttttgtgtaaaaggatgtagtctgcaatcattttctgactcttggtgtaataaaaattaagtggcctaattatttaaaagcttgtcgtttgaaattattttttgagaaacagtttaaagcatgatactatttttgcttttcatgtaatgtataagtattcgcagaagctgcttgtatatgtttgtgttccatgtatgaaaatgttgtaaacagggtccatgtatttccccagtgagagttgctgatcttttggctgtaattaccaagtgcttgaggttggggtggctggaaatgaatatcaagcttttcggtgcctggagccaactttgtccaaataaaagagctttgtactgtgaaggaattttactaagtaaattttgtttaaaaaatccacgtgaattaaaggaaaggaaatgaagaagaagatcgtatcaatacgatgatctaaatcagtgttctgcaacttttctacccagtcatcagtgggagtgaatcagtaggaatgtggggaagggagtgaggggagacccccttcttgactcagcagtggtgacggtcggtgtgtcctgcagacctgaagccaagatcaagggcgcttgagcaccaggagcccccgcagttcctgaatgaccagcggagggcaggtgccagcctgtggcaaaataggaaagaaaaggacaggatggggacttcaccatttttttcagccttaaattgttccttaaaccttcatgtccttttctctaatgtatgttcttgtttggtaaaataaaaaagtttgtaaccctgagttctctaaagatatacattcttttttactggtttgtgaagtcagaaggatgagagctgctatttcttggaaccgtgcaataaatattagcatattcagtctc

SEQ ID NO: 6325 - DNA, 2415 bp, Homo sapiens
aaataattggtgatccacaaaaagaaaataaagtgagagacaaattcctgactcttttaatgtcatactggttaaatattcggggggaaaatttttattaaaaatatgtgtacaaaatactttctaaaacaggcataattcatcacaattaattacagagggttgttcaaacaaatggatctacttctatagatatacatgcatatacagacatagatatagataaatatcaactttccttttagcatgaaaagacaagaaatttaaacaatagtgaactaataaaaatatacctccgttaaactgctcagactcaagaaaattagggtgaataatcatacatcacagatgatgaaagaagtactgtgttctcataccttgcatattacgattataaagtgttccacatttaggggttggcaaccaaacaatatctattaacaactaaaatatagaaaagcaaaatgcagcaatgctggtcctgagaatctccccagagtaataaacgcaggtataattacaagagcaaaatgcaggacaccaatacttctatgatatgacctgtatttggtgttgggctttacaggagctctttctcagacacatatgcattatctgtatcttttctgagattctactaactttatggtgaaatcaacaataaaaggttttcattttgataaattggttttcaaaagagaaagatgttacaagaccctttcaacttgtcttgcaagtgaaggctatatctgaggctgccaagaaaagttattgacaaaggcatggcaaaatgttaatgtggttttgttgaccactgtgtttgcagcacagtggagaaacagcgtggttttctgtccttgctgagttttatgcattttaaggaatcatatttgttcattccacattgcagaatgtttcttgcattttcatttcctaatgcagactaaatatcttatgtggtttgcaataattctctccttttaaaggtatttctggagtaactgcctggtctgtaacatgtttgatggatacctaacccttaaatattacaaaattttatgcacaatcactacttgattttgatggacataaaaacacgtttttaagttacagtagcaagatattatcgttgcctgtgttaactcattactgatactcggtttataatcatagccaccctttgtgaaaaggttagcttgttacattatggttatgctgagggaagaacaggctatcctggatgcttgagggcctctcgtggtgactgagtgttggcactagtgtcagttcatatctaaatattcctacatatgtaatgtactttcatattttttttgacaacacttgtctagggaatatttcaactctactctgtgcttttgggattcaatgggaatcccctttcagatggtcaacagtgtgagccttattgattgacctttttgccctcttccctgaaatatattctctaggtttaatctgtggaattagattttaagtcacattttcttgcgtaaatgtatgaaagcaggaaaaccggctgttgctcatattaacagcatttttttcacatagtgtaagaaaaacagtggtcttattcaccagaccaatcttgtattcccgctggtctcacagttcaagactcccttccccaggctttttgttctgaggtctggccatacaagcatcctagctgagtgggtggaaacgacatttacctggtacaggcctgacctgtgaaaacaccctctgtgaagccccaaatattttttgccatacaactgcatgaaattttcccaagcaccatagccagatttgaagacacaggttagcaatgagaaatacaccaatagaaggtatgggggtccctaaatccatatttggaggaaaatccacaagcagagtcacatgacatttgaaagcctgtgttgaggtggtatatgccagcaatgataaatattacatgatgatcaaactgctgataaattcaggtttgtctattacaacagctaattttacgttaactgtaacaaaaatatattgaagaaaagtttgcatggaaatttttatttttatatttatttatttctcctatctcagcctctcaagtagctgggactacaggcacttgccatcacgcccagctaatgtttgcatttttagtagaggcaaggtttcaccatattggtcaggctggtcttgaacttctgacctcaggtgatctgcctgccttggcctcccaaagtgctgggattataggtgtgagccactgcacctggcctggacaatttttattcaaattctgtgtacaacaaacatttcctgagtatttcaaaaggcgaaggaaaatataaaccatacagttattcatataagaaacctgtatcatgatcttcactctgtttttgaaattca

SEQ ID NO: 6326 - DNA, 987 bp, Homo sapiens
agttgtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttggtaggtgccatcatagtgctcggtggcctgtggtttcctgtggtcattttcattcatctccctcacctgaagcttcacttccagcaactcatctcaaagccttttggctcaggctctgggcaaaacgctgttcttagagacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaaggtgagcctgggcaggatctgtgggccacctcacactcacaccgcctcccctcagcaggaatagatgcttcctgtggctcgagggtttctggtggggctgctggatctgcgtggagcccgcaccattaccacctccctccatgctccagccgcccggagatcagagcttgccacgaaaggctgcttttagccctgatcacagggcagaggattctctagaagccctctcaggagagggtcttctgggcgggaagcgtccctggggtgagcaggccatcctgccttcaagttcccaa

SEQ ID NO: 6327 - DNA, 1665 bp, Homo sapiens
gtccccgccccctgctgggcctctctccgcagccgcgagacccgcgcttggcgcataggccggttctaatttacaagaacaccgcggcctgaggccggagagtcccttcaacccgggaggcggcggctgcagggagccgagacggcgccattgccctccagcctgggcaaaaagagcgaaactccgtctcaaaaaaaaaaaaacatggccgaaaccaggaagctgcgcgatggcgccacggcccctcttctcccggcctgtgtccggaaggtttccctccgaggcgccccggctcccgcaagcggaggagagggcgggacgtgccggggccggagctcagaggccctggggccgctctgctctcccgccatcgcaagggcggcgctgacctgaggcctccccgcaaaggtccccgaggcggcggcggcggcgggctgtgagaaccgcagaagaacgctgggcgcgcagcgacccgtccacccccgcgaggagagacttccacagaggcagcgtttccacagcccaaagccacgtttctagggtgatgcagccccagtaagttcctggcggggaagctcacggctgtcaaaagaactcttcgctccagccggcgcacgaaggggaggagggcaggaggctgccgcccgcacaggtcatctgatcacgtcgcccgccctagtctgcttttgtgaatctccactttgttcaacccccacccgccgtctctccctccctgcgccttccctctaaccttaaagacccagctacctctacgcaaatggtagctacctctgcgcaggtggaagttgagttcggttcacgcgggaccctcttccctgtggcaagctgctgaaggagacctgctgttactgctttagctgctgttctgcttaatctcagacagctggaaggtagtattccgccctcgcccagccacccgagtaaatgagaatgatgactgactgagaccctgatggtggtggcttaggcttaatctcagacagctggaaggtagtattccgccctcacccagccacccgagtaaatgagaatgatgactgactgagaccctgatggtggtggcttaggcaagatgaacgtctgaaatggaggcccagggctgccacgatggctctgtagtcatcagggagggagctccttttatcttgttacctactcccctcttgtgcccctttcttcccttgatctaagaaggttgctccggatctcgccatctggcctgcgttcaatcagcagaagcttcctggaggagcaggaggaggcactgtgctcgcatcacataccagtggccagaagttggcttcagggaagctcaggaaataggatgcgagaagccatgagacctccccaaactctgcagtaacagagtcaacaagacaatggcttaaagatggagagaccagttgatcggtcacacaagctgttccacgataattcttgtgtcagaaggggaggctgactaccaggaccactggccccacttccagcccctccattctgagtacacttcagagggctctggcagggtgagggggtcttggtggtgccacagagagtaaaggtctagcacacccattgtggagatatttcatggggacaacccagtgacttcacttgaagtaaagtgggattttccaaccttga

SEQ ID NO: 6328 - DNA, 3370 bp, Homo sapiens
gagacacactacaacaggagagggagcaagcgcgagaggatattagaagagaggcttgtctccaagatatggaaggaagtgagaaatgacagggctgcaagctttgtatgtaggagcccggcagggcgggggagcggcgaggagagccaagtggattctcagaaaaggggggaagccatcgaagagctaaaggtgattagagggggatattgatttcttattctgccagagatttaagcaggcatgcgaggaatctgcaccatggttggcaaaaagagacccgttgcctcctgtaaccagacactcaggctttccaggagcccagggagcaagccgagaagaaagggggcagtgtggtctaggaaaattcaacttgtcgctgatttgtgcctgatgcctgctgtccgtcagcagcctcccttacaatctttttttctctctctcctttttttttccttgccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgtgaa

SEQ ID NO: 6329 - DNA, 2231 bp, Homo sapiens
gtccttagcaaccagccttggttcccagcggctcagagcgcagcggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagatatgagaacacagattctgatatgggaggatatgaaattaaccacctgctctggcactgtgttgctgcttggtcttgtgttcagaataacagtcctcagttgaataacgtgcttgaacatctcgtcttccataagacacagcttcaaaagaaatgctggttggattcagtactggctttactggtccttggggaggctgccaaattaaacatggcctgcttgaaagctttaatggacgtagtgagagattttgtttcaagcattatgtctgttcaaaatcaggaagaaagttgcaaggtagatgatttttcctgggcctggaatgtagtctacatatatacagtaattcttgcagaaatctgcttgtatgcagccacttctgatttgcgaaaaactgctttaattggtttctgtcactgtaaaagttcacaaaaaaatattttatacttggacaaatcagtacctccagaattaaaggaaacaagtattttaagtcttttggaatatttctcttcaaaaatgtcagagaactgtgatcaagtagtctggactggttactatggcttagtgtataacctggtgaaaatttcatgggaacttcaaggagacgaagaacaggatggacttagaaacatgatatggcaaacattgcagaaaacaaaggattatgaggaagatgtacgaatccaaaatgcaatcaatatagctcagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtgttagaaactgaataaatggaaagggaacatagaaataacactgaaacagtagctgctggaaactgctaccacatttggagccatggaatcagagagaagaggtttgcattgttaaaatcgaagggatgtagaaggcacttcacacagccggactcggatccttgacagggagacattgcccagttattgctggtacttttgagggggcacaatacaactggttctgggagtgcagaaaaaagtgaaaactgaaacaacttgtatcttgctgaaaccacactatcagaaagagtgagaaaactggaagaatcaggtattttcttccctctcatcctgaaactcttcctgatgtgcttcctgttctccggcatcacaaagcagagaaaacaagggtggacttggagatgaaagacactagttaaataaatgaacattgtatggcttagaaggttatcagaccattcaataaaagttaactctcctttcttttcttttgcat

SEQ ID NO: 6330 - DNA, 2615 bp, Homo sapiens
cccgaccctctttagaaaaactaaccttctagtgaagatgcggtgatgcttagcacactcagggatttttttcaggacccattggatcctcaaaactccccgaattttgatactttcccagccgggcgctgattcgtcacggcgaagagggccgaggaggcccgacctaacacagaataggcctgggtttagcggctgtgaggagccggagccgccgcagcgaccgaggaagtggcgggaggtgccgagccttgcggaggggcggtgggggccgcggtgggagacggcggatggcgctcagcgcgaggccgcggaaccactgtggcagcaagcagttcggccagactcccgctgagcccgctcctggaggggccctccccgactccggtcttgctttcctttaggctgtgggtcagagtctacacttcactaaacctgggatggaggcgtggaggacttgcttcgcggcgtttgcgtcctcgcaggcgcctcgcagggcttcctgccctcacggcgggggagtagctttggcgaaaatcagcacgagttctgcagtttttccaagcgcttttagggtgtaatcgtcccaggtttctaagccaaggcccggagagttgaccccctcgcaacagcttgtgtgtccttgcagcgccgcgggtgccacctggtctccgcctcagcgctgcctcggctccttcggttcccaccagcgggaacgaccgtccccactttcagcttaaactcatctgtccttctggatccagctcagaggtctctttgtgatgccctcctggaacttcccccctagtaatccttcctttgtattcccgtggctctttgataataatggttggagtcctgaacccgaccctttgtatcggaccgtgtttgtcatctccagtgctttatgaaggccttgaaagcaaggttcagccgtctgtattggtcatcttcccattgccagtgcctacgaagggcttgacccattcattgttagacgctcagtaagtgtgtattgaggcagccctctgtgccactccagggctctttccactaaatcatgagtatgttggtttaccagatggaatgagtagcctcttctttggatacataaacacccgatggatattgtgggtcactgtggagggagaatgaacgtatgggatccctgacctgtggttactggaaaacagttgacatttagagagaggctgaattcttgggcttcccgtagcccccatcctgagtgtgccaacagggactagaagcatctctagtctgcaaagcgaggaacaagtgatactctgtccaatttttccaatattgttatactcatgaatagagattaatgaaattgaagagcatattcaagagaaagactaaaggagaagtcgtctgccccgtggacaggcagcttgagtggtgcttgagaaaatgtacatgaaattgcttgttaaaaaatattcacgcctgtaatcccagctcttttgggaggccgaggcgggcagattactaggtcaggagatcgagaccatcctggctaacacggtgaaaccccgtccctactaaaaatacaaaaacaaaattagccgggcgtggcggcgggcgcctgtggtcccagctattggggaggctgaggcaggagaatggcgtgaacccgggaggcggagcttgcagtgaacggagatggcgccactgcactccagcctgggcgagagagcgagactctgtctcaaaaaaaaaaaaattatatatatatatatgtatatatccatcagagacatgtaaaggattaaagtacgatacacaaaggcctcagaagggatttcagtacattctttttctggcttcgtccagcaactccagcctggtttcttccctgcctttgggattatggtgggaggattgggcgagtgcagtgctggggaggcgctgtgtgttgtctctaggcagtcctctgaagaaaaactgcaggttttggatgttaagaataaagcaccctatagtaggaaaggggtggcccaaaaacggcaaaaagggaaaggaggggacctaagtggagcagtgacattgtctgatacactttctcactgggtttctgctcagatgtcaccttcttagtaggtgtttcctgacctttttaaaattgcatctcattccccaacccccggtgtctgttcatggcctgtgctttactttttctgtagcacttgtcgctacctaacatactatacttcttatgaatttattttgttttgtctttttcttcttcttttctttttttttttgagacggagtttcgctcttattgcccaggctggagtgcaatggcgcgatcttggctcactacgacctccgtctcccgagttcaagtgattctcctgcctcagcctcccaagtagctgggattacggcatgtgccaccacaccctgctaattttgtatttttagtagagacgaggtttcaccatgttggtcaggctggtcttggactcctgacctcaagtgatccaccgcctcggcctcccaaagtgctggattacaggcatgagccaccgcacccagccgtcttttttttcccatcagggtggagattttgacatctggaacagtac

SEQ ID NO: 6331 - DNA, 1756 bp, Homo sapiens
aacaggtggccgttgtccgcgttgatggagaccagggaggcgaggggcagcctgggtgtcccgaagtcggtgacggtgatggtgatgttgtattcggatctggtctcccggtccagggccgtgcttatcaccagagtgtaaaagttctcaacagaaggtttcaagaaaaaaggaagatcatcttggatggagcacaccatccttccgttgtctccggagtcaggatctgaaacgctgaatacagcaatgagggtgtcctgcaagttttctgggatctgattgataagtgtcgacatagttagttccggaggattgtcattcaaatccatcacttggacaaataccacacaagttccagataggcccccaccatctgtcgcctgaatatttactgtgtatgtctggatggattcgaaatccagtttctgtcttaaaagcagttctcccgattttgcacttaatcgaaacgttttgcgaatgtcttcagatgcttgggaaaatgcataagatatttctccattagttccaatgtctaaatccctggcagagacgatggcaacctgggatccaacggggctgtcctccgggatctgcacctcatagagcagctttgcaaactctgggacgttgtcattgatgtccacaacttcaatccgtaccagggccgtgccggacctgggtggactcccgccatctagcgctgtgagggttaacctgatctcaggctgctcctcgcgatccagggctctgttcagcaccagctgtggtaatattatgccatcgagactgtcttgtaaattaagatgaaagtggaaattgggactgattgtgtaattttggagactgttggttcctacatccaagtcctgggcacgttctattaagaaagtagttccaggagtgatactttctggaattttcaaaagtatttctttgtctaggaaaactggggaatgatcatttacgtccctaatccgtagctccgcctgaaaaaactgcaagggattttctagtaacacctggaaaggtaggacacagggctctgtggggccgcacagctcctcccggtccaatttctcatttaacaacaaatccccggtctgcctatcgaactgcaaatgcattttttttcctttggaaacgaccctggcccccctcacagcaagttctcctatctccagccccaggtcttttaacaaattggccacaaaggagccactctccgtttcctcggccactgaatagtgcctaggctggcaactagcctgagctatgcccagcaaaacaaagaatatcaggacttgcctttgtttcggaacgcgctccttcccctctccggcctccattgctttctggtctctcaccaaacgtgctccagctctggctcacgttgtcgctaactctatctccccgtatctcgctgatactgggatgagtggacaatcctagggcccggatttcccggagcgaccgccttagaaagcctcctcttcctgcttgctgcttctttagctgagtatctgggtaaggagcgtcggctgggtgctttgtttctgctacttctaaggctgcagcgccaccccgcgtctcttccgagtatttattttctcctaaactttaagaaaatcccagtgctttctttcaggctgatggcaatcgaaattgagtattttcaagtagtgtctctcagtgtaccgaagtcttattggcgtttcgaaaggctcttcattgcacccatagagacagggcaagaata

SEQ ID NO: 6332 - DNA, 2068 bp, Homo sapiens
gccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 6333 - DNA, 1948 bp, Homo sapiens
taatactcaccaactttgagaaggttggtctctgctcttctgtatactttttatgaggcagtatcacttagggcttaaggtttaaactttctttttctctctgtgttcatttcatattgagattatggataaaaagtttgttctgacattgcttaacatttttctttaatcatgtgattacagaaattcaatgacttacaaaacaataaatgtaccttagaatgaaaaatgcatcagtaaggtctgtatttaaatgtggatgtagacatcataattaccaagacaagaaattgttttgagaaattctctgatgtttttcttcttcaggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttaga

SEQ ID NO: 6334 - DNA, 2589 bp, Homo sapiens
aatcgggctcgatgaggaagacgtgagtcagagcttgcgcctctcgcttccagctgtgggtggcgctaggcagcttcagccggaccgggtaggggtcctcgctcgctagcttgctgtttctcggagaagctcccgagtgtccggcctagaggccatgagaaggcagtgggggtctgccatgagggcggccgagcaggcgggctgcatggagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttcggctgtggtgcaggcataatcaccagcaacacccgggacaataatacgggggccacctacccccacctgaacttcagcattcccatcacggtgctccagccggccctgcagcagtacagccagacccaagacctaggtggcctccgtgagctggaccgcgctgctgagccagtcagggtggtgtggcggttgcagcggcccctggcagaggccccgcggagcaagctctgaggctgtgttaccacctttggaaagaagagtgacctttttctgctgtaggaagtgatgttgaggtgacggtggcctcaggattcagggcccagcccctgcaggggcccaggctgcctctcatctccacccactgactgcagactgggctttgggctctggggcaaacttctcttcagccccatggatccttaacctggcagcccgttttggggtgctttcttgagcccccagttctctgtcccctagcactagactcagctgtattgtttttccttctggggagcccactccaactgcacagaagttctgggcctgacaggtagattccagctggaaggcaggcccgtgcctggttttgcgtctgttcccctgagggccatcgtcatcctggagcttcaatggggccttggctcctgtctgcctctcagtcagagtcagggctgacaaaggactcagcttccttagcatctcagcagaaaccttgctctgaagaccagagacagaagggacagaaacaggagtgcctcctgctgtgccaggcccatgggcagtgcaggcagatccctgaaggtcagcactcctgggtcttcatatgccaacaggggcgctcttgacactgtgccttcattttccagcccacagcctgggtctcagggatcttgaggggtagaacatgtctggttggggcttgggaataaacatgatctattgaaaaacctctgtatttatatatcaaattgtttctttttttcaggagttgaactgggaataggcaagtaccaggcaaagaaacacaccctttccttttttttttttttttttctttagagctgtggtcttgctctctcacccaggctggagtgcagtgttgcgatcacagctcactgcagcctcaaactcctgggctccaggagacctcctgcctcagcctcctgaatagctgggactacagtcgcgcaccaccacgcctggctaattttttatttttgtagaaatggggtattgctttgttgcccgtgctggcttcagccttctggtttcaagcagtcctcctgcctcagcttcccaaagtgctgggattacaggtgtgagccactgtgcccaacccagaaatacaccctttctgtgctgttttctcagcagggtgtgagctcacgggatacggtcctgccagactggccctcatagctggtcatgtgccagtcagagctgggtggggcttgcaggtcccggaaggtggtggtcttgacctggcagcagatgcttaaagaatgcctaaggtgggtggcagttggggagttcaagggtgaatgaggccagggcagcccccaggagctgaggccaactctttgagtcaggactgtgccgtgtgcccagggccttgcatgtgtgggccctcgagtgatttctactggcaggctgaaagccctgtgaggggcggctgtgggcggaggccacgcaggaagagtgcttaggagtaacttgtttctaacacctgtgtgctgagtgccaatgctgggtgtggtgttatgatatatattggttttcatccagcattcctgactcgtaactctcatagtccttgttccagtctttgttagaatactgggtatgttagggcttgggacaggcctctgacctctgggtatcctttcactaatgttcgcccacctttttcacagtgggtcctaaagaccttcccatgagagggtctcaatcctaggggaaggaatgttgatgtcatgaaccttccataaaaacccaagaggacagggttcagagagcttctggatagctgaacacctggcacttcctggagtgtggcgtgcccagggagggcacggaagctctgcactccttccccttccctcattccttgctctatgtgcatctcttcatctgtatcctttgcgatatcctttataataaaccggtaaacataa

SEQ ID NO: 6335 - DNA, 545 bp, Homo sapiens
tcttaaatcattgaattagaaagctttgtctcaagtttaataatttgcctgaggtcacacagctggttaatggttaacatacttctctgataaaggtcactagaggttcttatgaagatacttttaggtggcgtaacaaatgtgtttatgcatattcaagacactcttgtatccacaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctcca

SEQ ID NO: 6336 - DNA, 618 bp, Homo sapiens
aggaagaaaagtgatcttcagtcaggagacttgggttctgggctctgtctgatgactggctctgtgatgtgagccaggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 6337 - DNA, 679 bp, Homo sapiens
aagagtcattttctgtggggcactgcccggtggctctggccccatggggccattggcccagcttgccattccctgagctccggtggcccattgttggaggagctgttcgcccagggcaggcccttgtggacctttctcaagctccaggcggggtctgaggcccatttgaaggtcaggaggcccgagctggtgacagtggtaaaactgctgaacgagaaggagcaggagctgcaggagaccgagcacttgctgcaccatgagaatgaagatttaaggaaacttgcagagaatgaaataactttgtgtcaaaaagaaataactcagctgaagcatcagaagaaacagatgaaaatgatttgatcctggaagtaactgcaggagttggaggtcaggaggcaatgttgtttacttcagagatatttgataggtatcagcaatatgctgcatttaaaagatgacattttgaaaccctggaatattttccaagtgaaataggtggccgtagacatgcgtctgccagcactgggggttcagaagtctataggcacatgaaatttgaaggaggtgtgcacagagtacaaagagtgccaaagacagaaaagcaaggctgcatccatactagcaccatgacagtagcaatattaccccagcctactgagattaattaattgaattgatc

SEQ ID NO: 6338 - DNA, 1046 bp, Homo sapiens
atttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaaggtgctaatgtctcttcatgaaatgttcccagcagtacatgcagcagaaatggccgtccagcaaaatccacattcatgggagtcttggcagactttgggacgtgctcaacttggtttaggagagataatcctggcaattcgaagttttcaagtagcccttcacatctatccaatgaaccctgaaatatggaaagaagacctctcttgggcaagaacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaacgcctggttgtaaaatatgtttttcagatgaggcatataaaaactaaaatggcaggattattgtatagtgtttggaatatgctttgataagttatgatttatatttctc

SEQ ID NO: 6339 - DNA, 1661 bp, Homo sapiens
tgggccccagagcagtccatcttcaaggtccggataacatgagaaatgagccttctcacattgttggggataagggactgtagctgctgggttagctgaatttcaaactgagcaatgggtaattgaagcttttgggctcgggggacaggtcagtgcccacgttgttgtattcccattttgtctcagtttgtttaacagttggccctaagttgaatgcagtcccagcggaatctgcctcaggaggatgattgtagtttgtgttttcagagatggtgacttctggcatgttagtgttttccataaaaacattttcttccaaggcatttcttgcagttgtgtcttttatattagtggtttctataaaatgttctgaaggagcagatacttccagaaaagggttttcttgaggactcaggtctcctaaggatgaaaaagccccttgtgaaggggaatttatgaggctcttcgctgcagagaacggaggcctgtttgcgagcatcagtctactcagataacttttctttctgaactttggactctttttgaccttgggtgttctgtgggtcatgcgggagcgagttttgtgaaagcggtatttttttctggaatgtgaaattggtttagaagccttcatatttgtaactctagcctttgcactttctaaaatggaaatagtgtgtgtgttgtctttccatctgtctctcacctgtggtagggcttttgcagggctggaggtagaaggcgcgcccttggagaagggtgtcagcacagagactgctgccttatgctcttgggtgaacgaaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtggttggcagtttaatgaacggtagtaacattgattccacatctaggtttactgctgagaaatatggcaaatgtaacttagtgcactgataacctcactctcgtcattggtgtctagctgctcactcccaaagcctgacaagttgatgccactgctgtctgagggctcctccggctcaacagtcagctcagtgcttgtgtaattcttccgggcttgtaacgtcttcatgaatgctccttctggattccctacagattcttcttcagctgtcaaaaaagagactgctttgctcatgaaagatgatgggatgggatgcatcagtccatagctgtacaccccagtcacacagagtaggagtcagcaaacatttgagtgccattcagagaggagacacacacacccaatcctaaacctatgaaatggcaacaacaaaaggagaaaatatatcttttgaaaacacggccatctacttggaacattccatagtgtgacatagagtaactctgcttaggattatttcattgatccccagggtccaattgcccagtgctcagtcaaagcccaaggtggaagacaagtgcttccctgatgag

SEQ ID NO: 6340 - DNA, 2407 bp, Homo sapiens
gaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcaaaaaaaaa

SEQ ID NO: 6341 - DNA, 1042 bp, Homo sapiens
gcgtggaaggcgctgggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaag

SEQ ID NO: 6342 - DNA, 805 bp, Homo sapiens
gcctgtaatctcagctactagggatgctgaggcaggagaatcgcttgaacccaagaaagaggtggaggttgcggtgagccaagattgcgccactgcactccagcctgggcaaacagagggagactccatcgccccccccaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattcagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgagtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcag

SEQ ID NO: 6343 - DNA, 1221 bp, Homo sapiens
gccaacactagaagcaaaagaattcaaaggctgggtggatatttaagaacttattctaacctgtcaggtttcaatttgtggggcttggtttaacagaggaaaaaaatataaattgattttctgatgtctcacaaatatcacatacctggaaaaaaattaaaacaaaaaatgaattttgtaaaaggttatgtatgacttccatttgctctgtaaaaaaatgaacaaagattgtgaaaggatcctcttccaccacatcatttaatgggttagcggaacagatagggagctatgacactagcaccaaagagagatttttcttctggttgggtggtgctggtgccacgcccctttctgggatttgacaagtctttcccactcacctatacaatatgccaaatcaactggagttgtcattctaatgttttaaagaatgattgggttcccccaaactgtaggaggtcgatggtaacaataaagtgatacaaaatgcttatgtcattataatttatgtaagggagaccattaggctgagaatcaatatgattgaggttatctattctcctgaaaagtgaattggagaataaagaaagaatatttgaaaggatgttgtgtactaggcaatatactagcatgtattagaaaatacggtaaactgtgggttagaagagtgaaagtagctggtatgatagagcactggactgagtaacgaagagattctagtcatggctcttgtggtcatttcatttttgagcctcacattcttccaattaatgagggtaccagattaaataaactctggggattcatcccaattcgaactctgtaattctctgaatgaactctctcttcaattaaagccaaattattaacattttaactcaagtttaaatttaatagagaagtcaaaatgaggtatgcactttgtggaatgtttttggtcttatcacaataacctgattaaaatggtgcctttatttccatgtttactcctttaaataagatgaaagctttcagaacatttatttgcaaaatgactgtcaatatcaacaatatgcatcaaagtaccatatatgctaagggagaggagcacttgatgggctgctatgttaactgtaaattgagaactgcttgttttatggcttttgctgttaaaaaaaaactgctggcttttaatatgtactttaaaatatactcatgtctgggagagaacttttaaaaaca

SEQ ID NO: 6344 - DNA, 924 bp, Homo sapiens
ccaacaggttctattttaggtatggtatgatataatcataatttatctcacctatatagttcacaaaatagtagcatcttgacagtttaataaaggcttttgaaatattggtataaagtgaacaacagaactttaatttgctcagatctaaagaaattgaattggtttctgcttgtgattatgaatcaatagagtatattaatggatcttagggagaaaattagagctcactttaaatataaacttataatagtaataattgcctgtttatttttccacagttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattc

SEQ ID NO: 6345 - DNA, 582 bp, Homo sapiens
ttttattcacaaagtacagagaatacatgaagttcctcactaagtgatcattatgccaaaatcaaaatttcaggtacttttagtgctattgagatgtattgatttattttctgtcaactactgtataattattttttttctgtctaccctcagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgc

SEQ ID NO: 6346 - DNA, 767 bp, Homo sapiens
aaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggt

SEQ ID NO: 6347 - DNA, 684 bp, Homo sapiens
gtttggccaagtaggggcctgaggattagggagacacagatggagagaaacaaagaccttagaagctgaaggggaagctgggagggatgcccaggagagagagtcctcaggaaaaggccccagaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgttttt

SEQ ID NO: 6348 - DNA, 1746 bp, Homo sapiens
cagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggcaagggctgggacggaggcttgtttgcgaggccgctcccacccgctcgtccccccgcgcacctttgctaggagcgggtcgcccgccaggcctcggggccgccctggtccagcgcccggtcccggcccgtgccgcccggtcggtgccttcgcccccagcggtgcggtgcccaagtgctgagtcaccgggcgggcccgggcgcggggcgtgggaccgaggccgccgcggggctgggcctgcgcgtggcgggagcgcggggagggattgccgcgggccggggaggggcgggggcgggcgtgctgccctctgtggtccttgggccgccgccgcgggtctgtcgtggtgcctggagcggctgtgctcgtcccttgcttggccgtgttctcgttcctgagggtcccgcggacaccgagtggcgcagtgccaggcccagcccggggatggcgactgcgcctgggcccgcctggtgtcttcgcatccctctccgctttccggcttcagcgctctaggtcagggagtcttcgcttttgtacagctctaaggctaggaatggtttttatatttttaaaaggctttggaaaacaaaaatacgcaacagagaccgtttgtgtgacactttgcagggaagtttgctggcctctgttctaggtcatgattgggctgcaagggcagagaaggtagccttgaacagaggtccttttcctcctcctaagctccgggagccagaggtttaactgacccttttggggatttttgagggcagtgatcttaactttgggtgcacagttagcttatttgaagatcttactaaaaatacaccagagcccaacctccgaccaattacatcaaaacctgtcctagtgcagggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 6349 - DNA, 424 bp, Homo sapiens
atcgtcctggggcagtttgcacgctgatggcccaaggtccgcgacccaggttcgcttgagtctctatcagagggcaagccaggcgtgctttatggacaatgcgctcctcaggccttgaccgcgtacttccccagcgggtacagccgctccttccgctgctgcttcttggtcttcgggttctcctcatgcttgttgagccggcggcgcatggcgcgtgtcttcttaggccgcaggtccaggggcttgtagttcctgcccttgtagaatttcctgaggttttctttctgagtctagttaataacagtgagaacacaggcaatggatttgcggacgactcggatcttagagagcttggaggccgcaccgcctgtcactttggcgacgcgcagctgggacagctccaccttcaggtcgtccagctgtt

SEQ ID NO: 6350 - DNA, 2623 bp, Homo sapiens
agggacctacagcgggcgcggcgccggcggtctgcggccggcggtgtagacgccccttcgccgggacctggcacccgaatccggcctgccgggcctctttgtgcagcgccttgctgacgcccagggttctgatgtagaagcctacaccagggcctgaggttgtgaaactcatggcagtccacgcctgagaagagaaggcctgaaagagaaggaagagcccatgggacttgccacggttttgacttacatctgcaactccaaggctacaggcaggaagtaagaacagtgctcaagtggcagcagatactgactatggcttcatttcacagcttcacacagcagggtagcagaaaacaaagaatgtaagattggacccagttgcagctgttcaccaactctgtgatcttcaaaaagccatatagcttctccagacctgttaatcagggaagaagcagataactgaaggctggctttgagaagtttcgaggtcattattctctactgtgttacactcagctgctttcacctggaaaagcagaggaatcaggctgtctcctgcagctgtcttggtccattctgctgcccaagcagtacacttggtttcagatggaaatctaggatcccaagcatgggtacatttgtcggcagcatttggaagtatttttcgtcatcaggatggcagtcaatttgcaattcagtcatctcagtgcaaggtagtttggcaaaaagattatgacacttaatggatttttttcctcttttaaatctgtttacccagcattttgtagtataatgcaatgtaataacattgcattattttgagcatagtttagaagccaagaagatgctttcaaacagctgacataattcagttatggcccagatgtcctgccttccccatcacacattcatattaatggtcttagaaagctgtttctgaggcaacagtttcttcctcaatatcatcctactggggaaattttggcagttgatgtctaatgttgatttttttttcctgattgattttaattgttcactgggcactttggggtagaattgttttaaaaatttggttactgggaaagctagacaagcctttgctatggtgaaagagacagaaggaatatagatataatttgtaagtggttatgccattgggcttaatgctttgcatacattatctagtttgcatctcctgatcgccctttaagtttgcttacggtaaagcattattccttgcttggcaatgcacagagaaaaattatttgctgaaggaccctgcaaatgagggacaggatcagagttggaactgtaaaccctgccactccatttcatgtgatcttcatgggtacagcagctataccctgccccagcaatgagtatggtagagccacattcaaaggcggactttggggtcagcattcctgaaaagagctgcttaagtttgcttctacatccaaaaacgatgcagtcacagtcaactaacactgagcttgctgggcatctcctgaacagaaatgtatgtggtggtccatgtagcatgtatgcgatataattggccacccacctttccttttcacattaacatttatcacagaaacacattcatttgctacagggatatttcacaatttggctgaactttgagagaagtgggtgaggaaaaggtagtttcgtaactagtttatatataaacctaaattgtagtgagtactcttgtaagtggagcatcttttctatggtaattataaatggctgttagcccctttgcactaaagctaggtgggtggttttgccacagaggtaaattatctttcgggcggtataaccaaacaaataaaatataaagtgagattcagggcatgttctgaatacagcagttaattaggcagctaagaaaactgtattttagcccctctgactatgtgattggtatttttttaaattaaaaaatggaaaataatatttttaacaggttatgatatgtcagtcatttaatcctcacagtaactctgtggggtaggtaggtactgtttctatctcattttacaggtaaggaatcaaaacagtgggtatacccaggttgtatatctagaaagtgatagagctgggattttaaactttataatctgattccagaatctctacctttaaacactatgttaccacttacttctcttcaaattttattgagcattagatgtttccagtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagtgagctcaaaatcaaaagaaaacccaccaacagtgaatgcattcagggctatttccaggtctttcttttgaagaaagataagactcagtccagagagcacatctgtgacacaccgtgcctcttgcctttggtgcgtggcagtcatctttggctcatgctgtaccttattctacattagaaaactcactgtatgttgctaaataattttttgaaaacaggcagattaataaatggacatcttatttattgcaccataaaa

SEQ ID NO: 6351 - DNA, 662 bp, Homo sapiens
gtctcactctgttgcccaggctggagtgcagttgcagtgacccaagattgcaccacggtactccagcctgggtgacagagccagactccgtctgaaaacaaacaaaaaaccaaaatgcaacaaaaaaattggaaatatatatcattattagatagaagccatttaaagtccatacctaacttcttgtgtgggaaacttaatttttattatgttttctgtagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaa

SEQ ID NO: 6352 - DNA, 577 bp, Homo sapiens
ttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctggtcagtatcttctttaatttcaaaacagtgcttcacagcttgtggtaaaactattggaagagatgccttgtgattgattgctttgcagaaggatgatgtggagaaaccta

SEQ ID NO: 6353 - DNA, 4820 bp, Homo sapiens
atagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaatacattttaaaagaaaaacaacaaggagaaagaacaggaagaaagaacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcaggactctctccttgtctggagttccagagagcccccactttctctttctaagctgtgttgtgtgtttcctggtacattctaggttccccaaagataaacatgactaaggattggaaaggaggaaaggccgcgcagattgttaatctgaaagtcaatccccggatttagctctcaaaaatgctttatttttggagaaaagcaatagagtaagacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggtagacctgggggagcagcctctcccgcccccaccccctcagcgtggtgctggcccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggt

SEQ ID NO: 6354 - DNA, 589 bp, Homo sapiens
acggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactgtaagtttctttgttttgtgctttaaaaaaaatctccctcatgagagagaaagtagtaaattaaaatacagctttgggaggtctcttctaagattaaaactatttttaccagtgttccaatattagtttaggcagtttggtctgattttaaaacagtcttattatgatatagcattatttttaaaatttatttattctttctgagaaggagtttttcgcttttgtcacccaggctggagtgcaatggcgccatctcggctcacttcaacctccgcctcccaggttcaagctattcttctgcctcagcctcccaagtagctgggattac

SEQ ID NO: 6355 - DNA, 651 bp, Homo sapiens
gcgaccggagcggtaggagcagcaatttatccgtgtgcagccccaaactggaaagaagatgctaattaaagtgaaggaaccaaagcggggagtgtgttcagtcagtacctgcctttctgagcctggcatcctggaccagcctcacttccttggctgaggcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggc

SEQ ID NO: 6356 - DNA, 3725 bp, Homo sapiens
atgtgggatctggagatgtaaacggatgcatggaaaagtccaaagcaaacacaagccatgtctgggagcagggccagagggggcccgtgggaatgctgtttagctctcagagcctgagatgggttggaactgcagtcagagttctttttccatcccttcggaacccaccactccctaccccacctctcacagcctctggccaccctgcagagggcccagcttcctgctcaactcctgccctgaccgagagggccaactcttccagttctattcaaatccacccatgtttcatttattcaccaggaaaaaaaaaaaaacaacctaacatctactttttattgaatactataatgtagatattattcccctttttacaacagaggacacggaaactcagatgaatttagcaacttaccctaggtcagtcacacttccagaaactgacagagaggacctcacatctagatcttccggcctccaaaatctccctcattgtgactccattctcctttcctcctcttttgccctgctggagggaggggaagagctgcatctcaccataccctcctcattgaaatgatgtgacatctgggacttgctttagtgtaacctagtgcagaaaagaagtgcaaggccaccaatgaaaccggtgctgactgctaaagttgagtgttgggttcattggagctccatatactactttaacatgttttaaattctcataataaaagagtaaaacaatatatcctctgcaaagttctggttagggcttatgggtatagaaacacctagtatgactggagcttcagtgatgatagagatcgtcagaaggttccagaacacagagctgcaagggactgcagggggtcaccaggtccagtccctgccttagagcaggacttcggccttctccagacacatcaacttgaaacaaggccaaggcctccctcctccccgtgattccatctcttggtgtgacgggcctcaacttagctgaaaaaccagccaaggatggagaaggctgcttcctccgatacaccttccacgtgaagttttaattgtctgtctctctgtgttttcccctttggcagatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatatatgatggtgtgctactgtgcaccttgtctcaactccactcttcgtgatagcatgttggtagcttgaaatcagcctggtgggagtattaccatggacactggcaaaagctacagatcccggagagccagtggttaaacatttaccagcataccactgctagtaatcaaggctaactggtccagaaatcgcccaggagaatgaaatggatgttccatttttttctactgacattgactagcatataaaaggtatagaaacagcactaagactttctgaaaatacctaatgaaaattttacatctttttttgtttttgtttttgtttttgagacagagtctcactctgttgccaggctggaatgcagtggcgtcatctcggctcactgcaacctccgcctcccagtttcaagcgattctcctgcctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaactta

SEQ ID NO: 6357 - DNA, 981 bp, Homo sapiens
agagctgggcggtggcgggcgctgctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgagggtaactatataaccttttgaacagtatgaactttggtgttatgtatgttgaaaaatattatattatctgttacagtaaggttaagaataaacacaattatctgctacattaagattaaagaataaatacaattctgtgttatatgttcagtttagaaattatctgaagcttataaaacaaattttattttaaaaaataagcttctaaacttcaaagaagagaccaaggtgctgtttcaaactccatcaattacagtgagatttttatagcattggagagccaattgctgtcccacattcttttcaagtcattattaaaaacttttgatataacttaagttttgattcatttcatcttctaccattatgataatctctacatccaaaaagttaagccattatttacagacattttagcataatagatactgcttattttgacatattgactgccaggatttgtaatctatattatgtttctaaggaaaagttttatctgttgttcagtgtccagatatagttattgtcagcttattttctttcttgaaaccaaagcaatgaatctattgtgataatctctccttaatatctgttatatattatagtaatcccttggtatctgtgggagattggttccagggactcgcctctgatatcaatatctgtggatactcaaactccttatggcatagtatttgcatataacttatgc

SEQ ID NO: 6358 - DNA, 557 bp, Homo sapiens
gacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcaggtgagccccggccggagcctctaccgccctccccaccacagccaccatctcctcctcttcacgctcttcctcctcctgggcctgcggccgtccccgcaagctgttacagtgctccgattctcaaagactcatgctcgggacccccggggtcctctctgaggcacgagtggcccagcctttcccacctgttgctcgctggagcccctaaagcgccgcagcccctttcttggctgcttggctgcagctct

SEQ ID NO: 6359 - DNA, 468 bp, Homo sapiens
gcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtctt

SEQ ID NO: 6360 - DNA, 3088 bp, Homo sapiens
agatgttcccaggacgcgagctaagtctgcccggccggcgcgcgccgcttccgctttggtgggaaggacctcccttcccccttatagaaacactttctccaggccgggccgggcttggtaaacctcagccgtgcctgggtagaggacgccgggctgggccgagcgggggtggaatgagggcgtctagaacagagaaaactaagtaggatggggtcgtccccccagtaatctggaaaacagttacagcaacaggctcctctcatcagacggcagtgctggtcgtttcctcactggtttgcggggaaggctgggcagaaaaaggatgcaaccttgttctcaaccacttgctatctcgtgattcagggattggatgagtctctatggtttgttttgccctgaagagcagaaggcttctgtcccaactggtgttgccaaagcaacatattaattccatgccatgatcctgggtcaagatctgcacaatctgattgggcatgtcacctcggatggcaagggagtggaagtggtcaaaatcatggagtcccagctttcggagacgccttgcagctgcccggtaacacttccagggttggggctccacaaggaggtagtggcagagggaggaaagatgggccaggaactcccataggccatggtctccatgattcagatgaatccacatggttattgacatgcagaagccaatgtcaaaaactgaacgtccaaattggcttaagaaagagctcaagagaaccttccgggtcctttgattcatgaagtccagggtgataaaagtcaaggcatcaggaaaaggacattctttttcggctcgcttcaccaggactggatctatgtcgcagcagaggagacggaattctcttgaggcatctgagcaggtttccccgtcaggtagggagaggaagtgtttgtatagagccacactcagatcctagaggaatccaaaacagctttgtcactgcagttctcaatcagtgaatggaagagaaatctgtatcattctcccactgagaatgccacttacctctggctgtataggatgtgaggttcctaaaccataacctaaagaggttgtgcaaaaattttctacagagtaggctctcagtgccctccaggggtcacatgctgtaatgcatcatccccatattttcctgacactgatgatagattgggttgtatagctgaaagttacagccaaatggatgcagcaaaggaacctacagcagtatttcccagcttaagtaatatgctgataaactcactctttttctgggtatctcaagaccccagggcggaagaaaggggtccagaggcataaccagtgtctcttaccaggaaagtgaggaatacagcaagcacaatcttacaaaaacctgcttctcagacccgcggtgggggaagtctggattccaaagtcctcattcagccttcactaaagcttcaattttactgtcttaggattcaccacctccttctgagacattctgcttctataaccatcattgctaaaagtcactgctaacaaccttctagacaagtccaatgatttgtgatttttaccacattagcaccttttttactcttaagtcaccatctcctttctctaactttgaattctttttttttttgagacaaagtctggttctgtcggccaggctggagtgcaatggcgtgatctcagcaacctctgcctcccaggttcaagcgattctcctgcctcagcctcctaagtagctgggattacaggcatgcatcaccacactcagctaatttttgtatttttattagagacagggtttcaccatgttggccaggctggtctttaactgacctcaagtgatccacctgcctcggcctcccaaagtgctgggactataggaatgagccactgcacctggcctctttgatttctataaccattataactaactcaaatttgtgtttttccacatagtattttcaaggcatttttctgtttactactttgtttgcttggtgtaacaagcatgtgaggaaaatatttatttatgccttttctgcaggtgaagaaaatgcacaatggaaaccacccagatgtccagtgatagtggcatggacaaataaatgtggtataatcatgaagatagaatactaaatagcagttaaaaaatgaaggcacccagcttggtgcacaacatggatgattctcacaaatacataatgttgagaaaaaaagcaagccataacagaaaatatatgaaaagcatccatttacatgaagctcaaaaatgggtgaaattaaagtacatcattcagggaagaaaaacagtacactataaagaaaagcaaggaaacaacagaaggctagttgttacctctgggtagagatagaggtttatgaacaggaaaaggcatataggggaagttgtggggtgctgaaaatgtttattatttatttatttatttatttttgagacaggatcttactctgtttcccaggctggagtacagtggtgtgatcactgcaaccttgacttcccaggctccagagatcctcctacttcagccttatgagtagctggaaccacaggtgcacaccaccatgcccagctaatttttgtatttttggtagggatgagattttgccatgttgcccaggctgatctcaaactcccgagctcaagcaatccaccagcgtcagtctctgaaaatgctgggattacagcgtcagccactgcacccagcagttttttgggttttttgttgttgttttatttgagacagggtctcacttcgtcacccaggctggggtatgtggcacaatcaaggctcactgcagcctcgacctcctgggttcaagcgatcctcctccctcagctctctaagtagctgggactacagatgcccaccaccacacctggctaattttttttagagatggggttttgccatgttgcccaggctgggaaaggagtttttaaaattgaaaaaaaaaagcacccataaattatggtacatctatccaatgaaacattaggaagctgctaaaaaaagaatgtggtgatataaataatctcagaattaaaagcta

SEQ ID NO: 6361 - DNA, 3087 bp, Homo sapiens
agatgttcccaggacgcgagctaagtctgcccggccggcgcgcgccgcttccgctttggtgggaaggacctcccttcccccttatagaaacactttctccaggccgggccgggcttggtaaacctcagccgtgcctgggtagaggacgccgggctgggccgagcgggggtggaatgagggcgtctagaacagagaaaactaagtaggatggggtcgtccccccagtaatctggaaaacagttacagcaacaggctcctctcatcagacggcagtgctggtcgtttcctcactggtttgcggggaaggctgggcagaaaaaggatgcaaccttgttctcaaccacttgctatctcgtgattcagggattggatgagtctctatggtttgttttgccctgaagagcagaaggcttctgtcccaactggtgttgccaaagcaacatattaattccatgccatgatcctgggtcaagatctgcacaatctgattgggcatgtcacctcggatggcaagggagtggaagtggtcaaaatcatggagtcccagctttcggagacgccttgcagctgcccggtaacacttccagggttggggctccacaaggaggtagtggcagagggaggaaagatgggccaggaactcccataggccatggtctccatgattcagatgaatccacatggttattgacatgcagaagccaatgtcaaaaactgaacgtccaaattggcttaagaaagagctcaagagaaccttccgggtcctttgattcatgaagtccagggtgataaaagtcaaggcatcaggaaaaggacattctttttcggctcgcttcaccaggactggatctatgtcgcagcagaggagacggaattctcttgaggcatctgagcaggtttccccgtcaggtagggagaggaagtgtttgtatagagccacactcagatcctagaggaatccaaaacagctttgtcactgcagttctcaatcagtgaatggaagagaaatctgtatcattctcccactgagaatgccacttacctctggctgtataggatgtgaggttcctaaaccataacctaaagaggttgtgcaaaaattttctacagagtaggctctcagtgccctccaggggtcacatgctgtaatgcatcatccccatattttcctgacactgatgatagattgggttgtatagctgaaagttacagccaaatggatgcagcaaaggaacctacagcagtatttcccagcttaagtaatatgctgataaactcactctttttctgggtatctcaagaccccagggcggaagaaaggggtccagaggcataaccagtgtctcttaccaggaaagtgaggaatacagcaagcacaatcttacaaaaacctgcttctcagacccgcggtgggggaagtctggattccaaagtcctcattcagccttcactaaagcttcaattttactgtcttaggattcaccacctccttctgagacattctgcttctataaccatcattgctaaaagtcactgctaacaaccttctagacaagtccaatgatttgtgatttttaccacattagcaccttttttactcttaagtcaccatctcctttctctaactttgaattctttttttttttgagacaaagtctggttctgtcggccaggctggagtgcaatggcgtgatctcagcaacctctgcctcccaggttcaagcgattctcctgcctcagcctcctaagtagctgggattacaggcatgcatcaccacactcagctaatttttgtatttttattagagacagggtttcaccatgttggccaggctggtctttaactgacctcaagtgatccacctgcctcggcctcccaaagtgctgggactataggaatgagccactgcacctggcctctttgatttctataaccattataactaactcaaatttgtgtttttccacatagtattttcaaggcatttttctgtttactactttgtttgcttggtgtaacaagcatgtgaggaaaatatttatttatgccttttctgcaggtgaagaaaatgcacaatggaaaccacccagatgtccagtgatagtggcatggacaaataaatgtggtataatcatgaagatagaatactaaatagcagttaaaaaatgaaggcacccagcttggtgcacaacatggatgattctcacaaatacataatgttgagaaaaaaagcaagccataacagaaaatatatgaaaagcatccatttacatgaagctcaaaaatgggtgaaattaaagtacatcattcagggaagaaaaacagtacactataaagaaaagcaaggaaacaacagaaggctagttgttacctctgggtagagatagaggtttatgaacaggaaaaggcatataggggaagttgtggggtgctgaaaatgtttattatttatttatttatttatttttgagacaggatcttactctgtttcccaggctggagtacagtggtgtgatcactgcaaccttgacttcccaggctccagagatcctcctacttcagccttatgagtagctggaaccacaggtgcacaccaccatgcccagctaatttttgtatttttggtagggatgagattttgccatgttgcccaggctgatctcaaactcccgagctcaagcaatccaccagcgtcagtctctgaaaatgctgggattacagcgtcagccactgcacccagcagttttttgggttttttgttgttgttttatttgagacagggtctcacttcgtcacccaggctggggtatgtggcacaatcaaggctcactgcagcctcgacctcctgggttcaagcgatcctcctccctcagctctctaagtagctgggactacagatgcccaccaccacacctggctaattttttttagagatggggttttgccatgttgcccaggctgggaaaggagtttttaaaattgaaaaaaaaaagcacccataaattatggtacatctatccaatgaaacattaggaagctgctaaaaaaagaatgtggtgatataaataatctcagaattaaaagct

SEQ ID NO: 6362 - DNA, 573 bp, Homo sapiens
gatatgaactcacaggctttgactgggaagatttacttaactggaaaacaacctgctgtatcaaatacatgtttaattttaattaaatacttttaaatggactttattttaggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcag

SEQ ID NO: 6363 - DNA, 1430 bp, Homo sapiens
gtgggttcgcggccgccggcccagtgaggctgggttcgaggagctggagcgggaaactggagcttaaattctggcggcgagatggacattctgaaatcagagatccttcggaagcggcagctggtggaggacaggaacctgctgagagaatacgtgaaggcaaatgatgcttatcttcagatggccattggaaatgcgccttggcccatcggtgtcactatgtgaagttgacacaaaattaaccatcacagctgccttcctgtgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaggccacggcccgccttgtccctgccgggtcccggccaggtgtgtgtgtgccccagctcgactctcggtggtctccaggctgcagcagaaggaataccttgggccctgtgctaatcacgagtctttcctgttcggagcagtgaggcctgagaccctcaacagtgctgtgtgtacagaaggcccccagaatccacacaaaggggccgcctgaaacctagagcatttgtgaaggaggaaaatggaaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccagagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaa

SEQ ID NO: 6364 - DNA, 4756 bp, Homo sapiens
cccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttaggtgctaggcccagcaatacatctcaagcacttcttgggcaaagcccaagcagtaaaaaagagtcacattacctaggttctgggtatagcaatatgtcacaaatgcccctaagaagagggcccaggaaaagagagtcaccttggtgagaatgtcagagatattccatttttgggtattcacaaaaaagaataaagtcccataacctagaaggtgggctctgctccatgacacaaatcaccctagtgggcaggtccattaaagagaaggctgtcaaagcacatagatgctgggcaaagtgatatgtcataatccccatgatgataggcccagagacatgtcacaatgacctctttaggcagagaccaggcagaagaatcacatcacttgtgtgctggccctagtgataagtcactctcatttctgtggacatggcccaggcagaagagcagagtcacattacctaagcgctgggtcaagagatatgtcacaatcttttacatgggcaaaacccaggtaaaaaagaggagtaatatcagatagtaggtgttgccagagatatgtcaaaatgccccctgtatgaaagactcaggcagtcaaaacacattagttggtttcttaacctagtgatatgttataatctttcctgtgggtatgatgcaggcagaagacgagagtcatgtgatggatgcagagacatgtcacaaggtcttctgtgggcagggtccagactgaagccttccacctgctaggggttgagcccaatgatatgtcacaatacccaaattatgcagggcccaggcaaaaaaaacgagaggcacatcacctgggttctggatccaatgatatatcacaattttctattttggcaagacccaggcagaaagaaaagttacatcacctaggtgatgaatgaaaatacatattataatagttttgtgggcaggacccatgcgggagagtcacatcacctaggtgttggacccagaaatatgtcacaatatacagtgtatacagagctgaggcatgagacaatagtaacttcactcatttgttgagcccagctatacaatccttttttgggcacagccgaagtagtagaggagagttacatcaccttggtgctgggtccagcaatgtgtcaccatacctgctgaggggagggtacaggcaagagagccacatcacttaggtgaggggcccagagatatctcacagtaccccctgtgggtagaactcaggaaaaaggagagagtcacataatctagaagctgagctcagctgtatgttacaatcacccagtggacaggtcccaggcatgagagtagagtcacatcacataggtgctggaccaagcaatttgtcacaaccttcactgtggacaggtccccagaaaaagagaatcacatcatttaggtaacaaaacctgagttagtcactgttacttgtttgggcagaggtcaggaagaagtgtcacacaacatgtatgctggactaagcaatacgtcactctctctgttttaggtatggcccaggcaggagagaagggtcatatcacctaagctctggattcgcagataggccccaatctcttttttgggcaatgctcgggtaagagagcagagtcacatcaagtggttgatgggcccagagatatatcacattgccccttgtggacagggaccaggcaggggactcacatcacaatagaggtaggacaaggaatacatcacaatacgttttgagagcagaaccaaaaaagagtaacataatctttgtgttgagtgcagcaatatgttacacttttctttgtgggcagaacgtgtaaagaaggaaaaagttggccggacacggtggcctgtaatcccaacactttgggaggtcaaggtgggcagatcacctgaggtcaggagttcaagaccagcctggccaacatggcaaaacgctgtctctactaaaaatacaaaaattggctgggtgtggtggcaggcacctgtaattctagctactcaggaggctgaggcaggagagtcacctgaacctttgaggcagaggctgcagtaagcaaagatcacgccactgcactccagtgtgggtgacacagcaagactccatctcaaaagaaaaaaaaataaagaaaggaaaagtcacataagctaggcacttggcccgtgatatgtcatagtcacccatttgagaagggaacagcgaagagaagagagtcacatcacctctctggtggacacagagatatctcacaatgctctctgtaggcagggccagggcacaagagttatataactcgggtgttagaccaagcaacatgtcacaatggctgatatgggccagacacagacaagggagtcacatatttgggtgtagggctcagttatatgttgaaatgccccctgtgggcagcgacaaagcagaagattcacatcacctggatataaggcccggtgatacgttacaattcccctgtgagcagcgctaaagcagaagaatagggtaatatcacctaggggctgagtccagtgatatgtcacaattccatctgggctgggcccaggcagatgtgtcaaatcatgaaggttctgtgaaggtgcatatatcacaatcacacctgcaggaaggtccaataatgagattaacaatctcacacaggtccgggttctaggtatgagagtcaacacctgtgtgttggatccaaatagatgagtcgtagtctcaacaattgacttgatccatgtgtgagatcctagtttctatttgcattactattggtaccagtacctattaattcttccaccttctacatctttgttctgtatgaatgtatatacaaagattgatacatatacaagattatatgagtatttctatgtaaatatgtacacaaaaattgttcctccaaagacatttttcagtatcttagcatattctaagggtgcagatgtagaattatttctcttctctggctcagtagcatgtcagaatggaacataggtatagaatgttttttgtatagacaaagcttcactttcaggggcaaggtttgggaaataagctgatagtaaagtcatgtaacactttctgtgcaggttaacatttctggaccttgctttccttctcagtgtatgcatgagctattctcatgcaccactgggggccagtcttgattaatctacagttgaaatttagagaactggctgattgaatccacctgggctgagctaactgacattgaaatcagctgggctgagcttattggccagttaaaatcatctgggctcaaatatcggctgactggagtcacctgggctaaactaattggctgattttaatctcctgggattggttaattgactgtaatgacctgatttgagttaattgactgattgaaatcaaaagtgctgacctaattggctgattgaaatcacctagaatgaggtaactgactgattggatttacctgatctgagctaattggctgatcagaattacctagaccaaattaattggctaattggaatacactgggctgagctaattggctgattgaaataatcagggctgagtaagtgggttgcttgtattcacctcccctgagaagaataagtagggaaatgatctctgacttacctttttttttataagacatactcataaatggacattacatagatatatttatatattgtatgtgtttgtatgtgtttatctacatatattatatctgttaaccttcaagttaaagtgtgcaaaggaatctgaaatttgctttcaatattgcagtctatcttcaatttacagaccttggcttttctaccccaattcaagaagtcacttcttcagtcaaccaaaccaattacaaaattgtgttccaatgtcacatgttcaaaaataaacagttcctgaaaagatgtaagctttaaatggaattagtcagcattttcaattttggttagtgcctttaaagctagtttatctctgtttctatattaatcggaatgaaaagaaacatttttgacttggcattgaatgacagttgtgattttagtaaatttcttgctcacacataggagcaacaaaaaaatacttttttttttttgagacagagtctcactctgttgcccaggctggactgcaatggcacaatctcagctcaccacaacctccatccaccaagttcaactgattctcttgccttagcctcccaagtagctaggattacaggcatgtatcaccaagcctggctaactttgtatttttagtagagacagagtttctccattgttggtcaggctggtctcgaactctcaacctcaggtaatccacccaccttggcctcccaaagtgctgggattacaggcatgagcctccgcaccccgccagtttcacaatacttttgagcatgggcatcaaagtatcctcaaggttaaaaatgttggggtccaagcattctacctctttgatttgtatggtttgaattatgactcagcattttaggaacatgttggctccataatctttcacccacaccccacttgaaaaagaagataatttttcagatacacttgcagatac

SEQ ID NO: 6365 - DNA, 545 bp, Homo sapiens
gtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaag

SEQ ID NO: 6366 - DNA, 601 bp, Homo sapiens
attgacacattgtaaaatttttccttgagtcatatgtgtacatctgttacatatgttttttgcactactcagtgggattcttaatttttcttcttagctactaactttattttcgtcagaaaactgcttttatatgtaagattttcaaaactaaagaatattccttttactgtaatataactacacaaaaaaatatgaagagaaataaacaattttatttgcaaaatctagatttcaactagtgggaagacctgtgagcagctctgcctgaagttggtcatgtttttgaaatacaccatacaatttttaaaatataatttagcagaaaatacaattttagaaaaatataatttagcagaccttaaaatacttgttaacttgtacttaatggcaaaattaaatacaagttaagaagtgttttattatgttgcctttttgaattcctaaagataaaaagtagtttccatagtttccaataaatgagtttttcttttttccaggggtggaagcagaagaatggggtaaatttcttcacaccaaaaataagctttacacggattttgatgaaattcgacaagaaattgaaaatgaaacagaaaga

SEQ ID NO: 6367 - DNA, 493 bp, Homo sapiens
caaatggaggcagcattaacagttctacacatttactggatcttttggatgaaccaattccaggtgttggtacatatgatgatttccatactattgattgggtgcgagaaaaatgtaaagacagagaaaggcatagacggtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctcccaaataaagcttattgagtgttgtaa

SEQ ID NO: 6368 - DNA, 1383 bp, Homo sapiens
caatttcagcttatgaacccctgtaaagcaatttcagctttgcttcatggtatatttgctttctatccagaggttaatttgttagttttcttaaaacaatgtttttcttaatggtcttattgtttagaagtaacaagtggactggaaaagtatatggggcctaagtttataacattgtcttctcattatcagggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaaacgaattaatacatgaaaggacttggaatactgcttgacatatctttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgagaagcaagagcctgagaatgctggagaaactggtcaagaagaggatgatggtttgcagaaaatacacacatctgtcactagaactccttcagttgttgaaagccaaaaaagacctttaaaaggagtgacattttctagggaggtaattgttgtggatcttgggaatgaataccctacacctcgaagctatactcgagaacataaagagaggaaatgaagctcaaaaaagggtaagagtgaaagaaaatgtaacgtttgactaacgttgaaagactgagggtacaaaatcatgttgaaacaacaaaacaatggggaattaagcaaataaagatattattttacctttgtgcagaaaggagtgagccatgtgcaaaattctgtaagtaaaatacttagagcttgaatataattttttaaaaattcaaatctgagttcaagaaattgattgtattgcccttaaaactatctactcaaacactgttctggcatgtgaataaagtgatttttgtttgtac

SEQ ID NO: 6369 - DNA, 651 bp, Homo sapiens
cagcctgtatctttctttaggactgtcccctacctcctttactctctaacagatttctgcttatcctggtgaatcctatttaagggagatggaaacaaacctggaggttgattacaaactgcagaggctgagaagggcagcttgctggctttcagccagtactctctcttggctaagggatatgggactttatgtgtacataggcagcaaggccagcctcagaaggaggggccaggcttcctgcagtttcacagccaccactccaacctgggtctcatgtctgtgtcctttgttgtaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 6370 - DNA, 4433 bp, Homo sapiens
gccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtgagagccaaggcctgttctttccacttctggggctgtgacttgagtttctccgcaggagcagatagtgtttgtgtagggactgcggacttttgcattacagcctccctgctttgcccgcctgctgctggaagcttagcagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtgtgctcggaaatctcttccttaactgtgactttctgacaggtggaggatgtggtcaggagtgggaaaaggattcgagacgggaagagggaggggttcaggatgaagagagataatctgtgccacagatgctggccctgcagttagctcccacctagtccgtgcacacacattctaatcccctcccattcctttacatgctgcggccagagaggcctttctcaaagtggaagtctcatcctcacttctctggttacagtgctgggccatggtaacttacaaggcttagcaggaactgtctgcgcactcccccttcctgcccactaccttgtttccctccagttgcgagagaaaacattgattgagcattaactatgtgccaggcttgtcctaagtcctttgcatgtattcactcaaacaatcctcacaacattcctatcacatctcccatttcacagtgagggttctaaagcacgtagtgggtgaggaacttgtccagggtcacacaactaagtgggggtggagaaacatcaaatctaggtggtccaggtggtggccagaacccatcagcacctcactacagctgcctccagtttctcgctctaggaaatactcttccctgtcaactcctgttgtcctctgggctcagttgacatgtcatctccttgaggaggacatcctgagatgctccccgactagggtgggcacccacttccacactccaaatgcctatttgacctgtgtatcgctgcatccccactgcctggcagatagcaggcccctaataaatatgatttgagcaaataaatatagttcttcaaaaaatagggaggacttcttgcttcaggtaatggtaggctaggacatttggaccaaccctcctgcagaaaatagccatttattttgatgcaatatatctggctatgactagagatttcaaatatttggagggctattatgtgaagaactaaacttactctttgtgacatagaggtcagaaattggtcgtttccatagagtatgagagagacagaattgtgctcatcataagtatcttttttaaaagttagacttaataaaatgggctgccttggtaggtggtgagttctctgtcacgaaagagattcagccacttgctctgagaaagcatggagaatatcaacattgtaagggtcgaccacctcatctctgaggccccctcctcacttaggttgccattgcaggtggaacactgggctgagtgtcaaagaacctgggttccacaagctgtgcgaccatggctggttgttttggatctcattcctaatatctgttagttaagctgacccgtcaatactgacccacttcacagagttatgaagggattaaattaggtattacatgtaaatctgttttgtttgctttttgttgttcttttttgttttgcttttttctttgcattatgaaatcccaagtcaactttttccattcttttatttttttaaaaattgacatcatcattataaccacaaaataatttttaaaatggaaaaaaaaaactcacctgcaaccccacaatctaatacaataatcatacttttttccctttattctcctttattgtgaccaaggatgactttgggcattgctgtgaggaactatttcgtttaacaccctactacctgaacatgatgcgtactcagcctttcaccaccccccaagtagctacacatgatgtgataatagtattggtggtggttttagagagttggagagaaaactgaagttggatttgggtaaaagaaaaaagagtgggaattattttttctccattctaaagcccataaagcaatgttaattgttcccacccctctgctattctgtctcctcaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaaacccacactttcccattttgtgcctcccttcctagagttttagccaaaggtttagctaagtaattggttttaccagcgcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggcactgatgagtaaggttggtataagttcctcagatcaacaaaaacccattttcctgtaagtcttacatttagtatttaaggaactaaaacttaaatacattttgtgaaatggttgacacttcactgataatgatttattgcttggattaataaattttccaaaagttgtcttatgtagaatatggtttgcaaccagcagaaccattaatctatactgcaatgatatgcactatgtataattgtttaaaagcctctacttaatgatgtaaaatgctctatttaattacacatttgggtaaactgtatactaacatctgatggcatttttccactgtttgttgcttttttcaaatactttattgtacaaagctgttcttaatatttttcaagtttttttctttgaattttgctaatgttttccttgaattatgagcactgacagaatgtgcttagcacttttggctattcacacagcttttgagcatgatttgcatccaatatttacattgctagcaataataagccatctgtgagttttgtcaaaa

SEQ ID NO: 6371 - DNA, 4275 bp, Homo sapiens
gcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccatcaacctcatacgtatctacctggtctctgatcgaagctaccgtaatgtgttcttgaggtcaacatgttttgtggaagtcactgtatttgcccctttatgtcaattacctattataaaccgagagaaatgggaaaattaaaaacctgttttgaattatttttaatgcagaactattttttcaagtgaaatcttatacagaagtctggtatatgaaacagataaaaatgaaccaatgagattgaagggaatgagtagcatgtaatcctgcccactcttcggagaatttgaggcaactttgtagagccttaggagttcagtttgtatgttactgggtaatttaaagcagaaattttaatctgactgcacttaagaatcatctgaagtgtttgtattggttagtcttatttttaatactgatgtcctggtctctctcccctcaaaaaaactctgctgctgggaccaagcacatagatgctttttaaaaagctcccgaaaatgactctaatatgcagccaggattgaaaataactaccctacacagcatttttcctgattctgagcactcagcttttcattgattttccctagggcaagtccttcatcttattctgggtccttgtgttttctttctgaacctacaatttctccataggtcccatggttttcaaaatttctcattttccattttctgtccttttatattacctacttgaaaaccacagtcatctttcaaaacaaaacactgcctgtttcttaggtctttattgtgggcttgttattcctcaatacaaatttacataaaataataacaattaagacatgggccttggtgtcagaattattttatatctttcttattaactctgcagcttaccagctctggataagttaaaggacagctatagtcttactacatagaatcattataaggaattggtggagtgatccttataaagtgtttgcatggtacctagcacagagaaagtgcttgaagttgttaactgttatggttacaaaatatgtaaataatttttattgtccaattttctctcttcatatacactaaattgttctaattcttgaaccacagtaacaacgtgtgaatgacttatgcattcagtgtgtccactcaactactatttattaagtacctgttatggtctatgaaaggaactggcaagacagtcattattccccttaaatattcccaagtgttagtggtcaaagtttctctctgctgaaaatgaaaagtaccccgtaggatggaggaaacagccatcttgagggctaaatctggtctaacataatatttgttgacctgttactacagtgttgccacatatgctttgttggttttttaatttagcccccaaacattttaaaaatcagatcatttcatgttaaaagaaatctagacttctagttctcttgcaaatgtgagctctgacaaacattgaaattatagagtagcaggggtagtgtgccctttatttggtgcatgtcttctgcaggttcccaagttctgctgttctctgttgttgcctcatcactgaggccaaatgtcagttgctgcttacatgcatttgaacagttgttattttttatagtgaaattaaaggtaaactgttttgatatccatgtttctaccaaaggtaagaaaacacaagccaaaaagacacagatttcaaaaaaaataagagaaagcataattctttatggaagtgaagaatagtctttttatctaagtatgccaaaaaaagcatgtataaaaaaatacaatttaagatgccattatgaaaaaactccaagtcagtgtttactaacatcttttcagttttaggaaggaggcaggttgtcttgcatctcattggatctccggtactacctatttcttgaaataccataagtgctaatatatacttgcaatagataaacatgaggagtattacaaatacaagagatagcaggaactattttaatattaagagatatcaaatatgcacgctaggattaataaatgaaataattattttccttcttctacaatatttacttaatctggaggcagaaatacatgttgtctctcttcctgcttctccatcaaaatcccgaccaagtaatcaggatctttgagaatcacaataagaattacagcctcatgtttggattttttaaatttaaattttaaattactcctttccactgatatttattgagaaactgctatgctccaggtactgcgataaacactgggcaaatgttggagagctaaaaaggcatattcctcttataaagacattatttacttgtaacaaacaagtaaataaatgtattagtcaatatgtaagtaaacaaaaaaatggacaagcacaaattatattaagtactatgtaggaaaccaatagagtactgtaacagaataataaggtatatgggatgggggtgggaatctgttcagagatgatctacctgagaaggtaacatgtaggcagagatctgaatcgtgaggagtcagcctttcagagtaagtggagtaggcacttccaagagaaaagcatattcctggctatttgcctatcaatgtcatcttgaacaagggttagcaatctcctacctgtaccacagatgctatgtgccacctccatgctacctttgccaccaagagattcaatgtgatgcatgatttgaaggttcctcatcctgataccctgtggaaagtaaaatcagtgacaaataaaagcagatcattatctcaggtagagtctgctaaagatgatacttgcttgtcagtacatgagtatccaccctagtaaaaaaccacagaagaagtgggatttatcttcaatgttctctcacttccccttccaagtgcctctcctgccttctgatgctctttcccacaagttgcaggcaaataaagcatgtatattactctctttttatccagagttgctccttgtccttatatgaagtagattccagacctcacaattgtatatgcctacccttctactccaacccctcaaaaaaagaggaagaatgaaagaatgaacaagagaaaaggaaggaagagagggagagaggaaaggagggaaggatggtcctgaagatcacagttcggtgctgaaaaaagcatttctattaaacttcaagacagaatgaatgaccatagctaataatgtaccttaagcttttctagaatctttgtattaaaaaagttgattgttactaaatgtattttaatctcataaaattttaggaatttaaatgaagaatttcacaaagggtaagaaaaattatatattatatttataaatttgtcattatgattctcccattgtggaaaaaaaaacaaaatctcggtaccccaattcacaaagccaaaaggaagaaagtaagctgaacgctgagtcatgcaagaaactgctcgcttttgttcctaagctaatagctacagataaaaggtcagatatctccataggtaggtactctatgttcaccttatgtaaagtgccaatttattgagcgtaagaggattacctaattgactattccccagcctgctccttttctcttgcaacacatggagtcagcaatgggaccatatcctctctctttcccctccagcctgctttccccctttaaatactgaagccctcaaaatcatctttctaaaaaggtatgaaccatagattgttcctgtggatttgtgtttctttcttccgggcatatccttaagcttggcaaaataaaattctaaattgat

SEQ ID NO: 6372 - DNA, 6606 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaaacccacactttcccattttgtgcctcccttcctagagttttagccaaaggtttagctaagtaattggttttaccagcgcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggcactgatgagtaaggttggtataagttcctcagatcaacaaaaacccattttcctgtaagtcttacatttagtatttaaggaactaaaacttaaatacattttgtgaaatggttgacacttcactgataatgatttattgcttggattaataaattttccaaaagttgtcttatgtagaatatggtttgcaaccagcagaaccattaatctatactgcaatgatatgcactatgtataattgtttaaaagcctctacttaatgatgtaaaatgctctatttaattacacatttgggtaaactgtatactaacatctgatggcatttttccactgtttgttgcttttttcaaatactttattgtacaaagctgttcttaatatttttcaagtttttttctttgaattttgctaatgttttccttgaattatgagcactgacagaatgtgcttagcacttttggctattcacacagcttttgagcatgatttgcatccaatatttacattgctagcaataataagccatctgtgagttttgtcaaaagttattggggattttttaaattttagaaatgcaaattattgtttctttgaactaactcttatgcagttgcaaaggcatttccagttgttatagtttgtgtacaatatcaggtgttccagattatgattcattattaatatcattgcttccttgttccctctgaggtccagaagattcatgtttacaatatttagaaacaatgttaaaaaggtatccaaagtttgtcactttattattagtttgttcttaatattctgtttaagtttttgaattcatagatatcaaaacgctgcacaattatgatttccacaggaataacaacacactaacaataagaaccaaaaacagcaaataggctgcctacaagttttgacaatattaggataatgataatgacagtttttctaaatctcacagtaaagaatgcagcaacccagcaacactgctacctgtggcctcaggctgcagtgtcagctcttccctgggtctccagcctgccagtctaacctgaaaattatgtacttgccagcccccacagtcacgtgagtgaactggcccaggctggtcaccagggtcagtttctctgtgtgtcattaattcattcagtcttcagcagtctctttggagctgagatgtacctaccatctgccttttgggtgcttagggtggagaaccagaaaagtataacctagtgtgtatcctcaaagagctaacaatatggggtggtacctataggtctggaaacactttactgactctgtgaggcataccaggagacgtcagagaacagtccctcctcaaatgccaaatgagatgcagaagaaatagtttgctcaagttcatgggccagatatcccagtggtcagggagtttcatgaatgagatggaactttgcatggaacccgagggatgtgtatgatttgagtagatgaagaaaatgagactttccaagcagctagaagttagggagcagcaagatgtgtggtgggattgagcacagttggttcagaggatagactgcagttttaataatttgtagtaaatatctcccaactgtttggcactattggagcaagttcttgaatgccaaatgaaggcataaatcagtaagaggcataataaaaggctgagcagtgcttggctttttacgaactgatcctgataggagcagctgttcaacaaagttgccaggtcaccgttacatagtccctgccttctaggggctcactgcctactgggagagacagtctgaaagttggtggagcatgtaactgttggatgaggagtttgagcctgtggactgtgggacccccgaggagggtgtggctactctaggcagaacaatcccacagtttatttatatttaaccttgaaattcattagaggatttttcagcagaggtttggtacttgttaatgttaaggtttgcattctctagaacctcaaggaaagctgtaccgtgcataatgtaccctcttatgttaatgttgtgtactgtgatcctgtttcagggacttgcacttaggaatctgttacagtgagcacagaagcagacctgtgggctcatagtcttcaccccccacccatatatacaagatgaacagagtggaggttaaacaacttgactaaacaacacagttcatggtaaagcccaagactgtacctgcccatccactgccttttccatgtatcctggaactgagcatagacctcttcccaggcagagctgacagcaagtaaaggagatcataatcaggggaccaaacaactttgtctaaagtgtgaatgtcacctaaggagaagctgtgagatcagaagggtggggcagaggagcagacaccatgagggagagtccttgggggtacatctgccagactgacactgtctggcctgggcagtggaggggctagcaggaaccacaggtactggtggtgtggctactaccgttacaactgcctgtgcttggacatggaccctctgcaatatgcggcagtttcattcattgccccctacattctacaccaagtagaaatggaaggcaattggatacttcacagacaagatctaagtggagaaggaatgcgtcctgtggctgcagagatccttggagcttggaggggagagcttgagccccactgatgatgacctcccacagctcgccaactcagccctccctaagtccccatcgggggccaattctcactctggggttggggggactccaccatagctcatccatcatagggatgttggtatctactgtgggttgggtagggccgatgtgctgaggatggctcccccacaagcaagagatgtggatttggggagcttcccatcttgtgttgaaggaacataactcagaataataagagccaactataacaaacccacagccaacatcatactgaatgggcaaaagctgcaggcattccccttgaaaagtggcacaggataaggaagccctttctcaccactcctattcaatatagtgttgaaagtcctgatcacagcagtcaggcaacagaaataataaagggcatccaaataggaagagaggaagtcaaactatccttgtttgcagacagtatgattctatatctagaaaaccccatagcctcagcccaaaaggtccttcatctgataatttcagcaaagtttcaggagacaaaatcagtgtacaaaaatcactaacattcctatacacagtcgccaagccaagagccaaatcaggagcacaatcccattcataattgccacaaaaaagaataaaatacccaggaatgcagctaaccaaggaagtaaaggatctctacaatgagaatcacaaacgctgctcaaagaaatcagagatgacacaaacaaatggaaaaactttccatgctcatggctaggaagaatcaatatcattaaagtggccatactacccaaagcaatttatagattcaatgctattcctatcaaactatcaattacatttttcacagaactagaaaaaacttaaaattcatatggaaccaaaaagcctgagtagtcaaggcaatcctaaacaaaaagaacaaaggtggaggcatcacattacctaacttcaaactacagggctaccatgaccaaaacagcatggtactggtacaaaagcagacacacagaccagtgggacagaatagagagcccaaaaataaggccacaaacctacagccatctgatcttcaacaaagttgacaaaaacaagcaatggggaaaggtctccctattcaataaatggtgctgggataactggctggccatatgcagaagatcgtaactggaccccttttactatgtacaaaaattaagatggtttaaagagttaaaacccaaaattataaaaatcctgaagataacttaggcaataccattctggacataggaactggcaaatatttcatgatgaagacaccaaaagcaattgtaacaaaagcaaaaatggacaaattggatttaagagctttttcatagcaaaataaacaacagggcagacaatctaccaaatgacagaaaatttttgcaaactatgcatctgacaaggggctaatatctagcatctataaggaatttaaacacagttacagg

SEQ ID NO: 6373 - DNA, 461 bp, Homo sapiens
atctttttcctgggatttttgatacaaaaaacaatatatggccaatcagtagcttatgttattttaatgtaaattcttgataacttagaaactgccttttcctttaaaagcccacttgtcactgctgctgatgggagcatatattcagggcaacttgaattgatgttcctgggttgcagttctcaaacttggcctgaataaactctacgatcctgtttttacttattttgtagtaagatttaattgttttgaaaacaaagtatgcattttgttgtcttcctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttg

SEQ ID NO: 6374 - DNA, 569 bp, Homo sapiens
gcgggtggttggaaagacggtgaatggaaaggggatggctggtggtcttgggtgtgatgtgtgttattggtttgtagaggtaagtgacccagcaaccgggctggggcccgcagcctcaatccgcaaagataggggtcgaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgct

SEQ ID NO: 6375 - DNA, 504 bp, Homo sapiens
aactaagtcacgtgagaacctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgcccccaccgccatcaccacctcggaacccagggtaacgctgtcagtctttgatgatgtcagaagtgggatccaaagtagagcttataatgacacctaggagtgctgagtgaccaagcaaggtacccaccaggccgattatgtccattgttctcttggagcagctggtcatcatg

SEQ ID NO: 6376 - DNA, 535 bp, Homo sapiens
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtgtgtctcaccaagacagtgagaccgactcccccctcgtcatggtgttttgtgcctggactcgggacgcccgacagcctcctgcatct

SEQ ID NO: 6377 - DNA, 2243 bp, Homo sapiens
gacagatcctgctcctctcaatccaatcctgtagatttcttcagttacctcaacagggtcatactggctcctgaaatgggcaccattatttaaaagaaatagaggtacagagtcctcaagatttatgggcacctgagtttctgccccgtgccccgctgcaggtttcccaatcccctaaagacattcatggatgggtgagaggagctgacacctcccgctctgtgaccactttctctttggccatggaggaagtcttgctgcccctggctgtgacatctgaccccaggccctttaatcaacaactcccagagcctccagacccaagatgtgttttggaaccccaggacaatcctgaactggcacttgccctggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatggtctgttcctggtttcccagatgcataaaggaagacatatccctcccctgggcagcaaggctacaatgggagggagggagaacatgggagcatgtgaataaaatggcattaaatactgaaccaggg

SEQ ID NO: 6378 - DNA, 476 bp, Homo sapiens
gttatttctgcttctctctctctctctcttttgggttttattcacaggaattgctggtcatgtcttatactatattttgggtggttttttttcttcactctcactcccttgcaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactg

SEQ ID NO: 6379 - DNA, 897 bp, Homo sapiens
cctcctcataatccttctcaagggcagccatatcttcacgggcctctgaaaactcgccttcctccatcccctcacccacgtaccagtgaacaaaggcacgcttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatgctgcgcttggttttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcgggggtagggcaccaggttggtctggaattctgtcaggtcaacattcagggctccatcaaatctcagggaagcagtgatggaggacacaatctggctaataaggcggttaaggttagtgtaggttgggcgctcgatatcgaggtttctacgacagatgtcatagatggcctcattgtctaccatgaaggcacaatcagagtgctccagggtggtgtgggtggtgaggatggagttgtagggctcaactacagctgtggaaacctggggtgctgggtaaatggagaactccagcttggacttcttgccataatcaactgagagacgttccatgagcagggaggcgaaggcgacaggagcagacaccgggtcccggttaccgtccc

SEQ ID NO: 6380 - DNA, 826 bp, Homo sapiens
ggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtaagccttagaacccacagcccatggcctccctgcttccagccccattcctggccttgcccagtcctgtcctctctgggtggcacttgcacttgcaggtttatggcaggtaaacctgctgtgacccatgatgttgatggaagcagtgcaccaccttgtggacaggaaagttggtgtgtggattccggggttcccgagcctgcatgctctgggtcgagagttccaatgcttgcttctattgcagtttgttcccaatctgcgaaatactccttcacggttaggacaggaacccaagcatgagaacagggcctgttaactaaagaaaagtttccccatctcccaggagggttctgtgggccctccagagatcatcagcctcttcacgggctagaaaggatccagggaaggtctaaccaatgacctgccctgaatggtgagctgcaggtgtgtcatttagtgtgattttcctgttgactgactcataggagccctgctctgtggcagagctagcctctggctgtattcaaattgacttagtg

SEQ ID NO: 6381 - DNA, 507 bp, Homo sapiens
gggaagagtctgcagagcctttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttaactacaactccaggagaaacaaaacttctggcctctgaaatctatgacattcttcagtcctccaatatggcagatggtgatagttttaatgagat

SEQ ID NO: 6382 - DNA, 721 bp, Homo sapiens
aaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagacccagggcccccaacacccgaagaagaactgtctgcagctagagcctctgaggaaggactgcactgacacagccgtgatgtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgt

SEQ ID NO: 6383 - DNA, 727 bp, Homo sapiens
gccacgcagaaaaaggaggggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcg

SEQ ID NO: 6384 - DNA, 2511 bp, Homo sapiens
cgcgtcacagtgacagccaccgttgcctggggacgggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggaattatccgatgaaaagtagaagaggttgaatgactttcagtggccttttcttcacagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcctctagaacctccagaaggaacatggctctgctaatactatgatattagccctttcagactgatttcagacttctgaccagcagaggtataaatcataattatattgatttaagccactaaattagtggttattagtaacggcagcaacaggaaactatatcagcaacaagactccttccttcatagaacccaattcccaaccaattttcaaactttcacagaaaatcttgccacacactgagactaggaacatccaacaaaaaaatgctatcactttcaaatggaaaacccaggattgtagagaagatcaaattttgtcatgtatcacatttaaacactcatctctacctcaccaaaccgtggtactaatgtgtaccaatcttaaaaggaggtatttctgttccctcagagctctgggcagaagactatgcctgtggacaatgtagaattatctgctgaatgaatatctgaaaactgtttggagaggggaaaagcattgagaagaattgggctctttgctactattactcgctagaatgggagacgtttggaagcagttcccttaaggaaccaaacaaggcaggaaattctgggataaatctggtgttcacattacacaacaaaatgattgtacttcaagaaggaaagaaacagcaactcacgtggggcatggttttttagaactgatcaattttctgggttcttctcctggaggtgtgcaaagtccagagaagccagtgctggacaaggaaaagaagccacaagattagacttggctcacagcccacaaaataaactacttagaactacctttacttctcctcttttgggaatttggaaaaaatctcagttcttccacaaacccaatggaagccagctactgcagaaggggttcaggcagacctttccttaatgtccatgttgaacaggaccctaggtgctgttactttcccatggcatctcctcttccacagtagaacagaggcatgcccagggagccccccaccatcctcctggacccaaacactaagtcaggtactttgctcccaatcttaggaaggggcttcagagaccaaaatgtggccttctttcagacgtcatgaacatcagctagactcacagacattttgacagacatatcagggtcaacagatccaaaacagtctcatcccactcccctgaatctagttctttcttgcctgtttactcttccctataaaagaaaattcctttatgcctgacctttgctatgcttgcagatcttatggctggagtattctcccaattacaacacctcctcccttactgcagtgttcctgtgaataaagtcattccttaccaaa

SEQ ID NO: 6385 - DNA, 2510 bp, Homo sapiens
cgcgtcacagtgacagccaccgttgcctggggacgggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggaattatccgatgaaaagtagaagaggttgaatgactttcagtggccttttcttcacagggctcacctgaaacttcatgtaccattgcacttcctgagaagctgtccccaatcccaggctcctagcaatgctgttccagtaatctctcttctgtaagacagccactccacccactgcagtctacaaggaaagcctccatagctgtgattattcagtaagaacagtctcaggaaaacaggaccttcaacagagataagagaattaaaatatgcagactaacaactctgggaatgggctgaccagcctgataagaataggctgatggcacctacagaaggccacaaaacactgaccaagaaagcaatgaccaacaaagcaatgacctgagactgcacatttcacaagaatgttttgatcatcattttttctaatttcccttaaaaacccctgatatggagacagaactcggcggtctttgaacactagttcactgcctcccctgggttgttggattcctgaatagagctaaccatcctttcaccaatgctcatctcttaaactttcaagtgacaagtggtctggacctgaatttcgttacaaaacctatgtataccttaccttacatggcaaaggggactttagaagtgcaattaaattaaggatcttgagagggggttatcctggattatctggttgggcccaatgtatttgtaagtgatagagggaggcaggtgagtaaaaaaaggaaacgtgatgatgaaagcacaagtcaaaatgtgattgctggctttgaaaatggatggaagccacaccccagggatcgtggacagcctttagaaccagaaaaggacaaggaaacagattctccagtcctctagaacctccagaaggaacatggctctgctaatactatgatattagccctttcagactgatttcagacttctgaccagcagaggtataaatcataattatattgatttaagccactaaattagtggttattagtaacggcagcaacaggaaactatatcagcaacaagactccttccttcatagaacccaattcccaaccaattttcaaactttcacagaaaatcttgccacacactgagactaggaacatccaacaaaaaaatgctatcactttcaaatggaaaacccaggattgtagagaagatcaaattttgtcatgtatcacatttaaacactcatctctacctcaccaaaccgtggtactaatgtgtaccaatcttaaaaggaggtatttctgttccctcagagctctgggcagaagactatgcctgtggacaatgtagaattatctgctgaatgaatatctgaaaactgtttggagaggggaaaagcattgagaagaattgggctctttgctactattactcgctagaatgggagacgtttggaagcagttcccttaaggaaccaaacaaggcaggaaattctgggataaatctggtgttcacattacacaacaaaatgattgtacttcaagaaggaaagaaacagcaactcacgtggggcatggttttttagaactgatcaattttctgggttcttctcctggaggtgtgcaaagtccagagaagccagtgctggacaaggaaaagaagccacaagattagacttggctcacagcccacaaaataaactacttagaactacctttacttctcctcttttgggaatttggaaaaaatctcagttcttccacaaacccaatggaagccagctactgcagaaggggttcaggcagacctttccttaatgtccatgttgaacaggaccctaggtgctgttactttcccatggcatctcctcttccacagtagaacagaggcatgcccagggagccccccaccatcctcctggacccaaacactaagtcaggtactttgctcccaatcttaggaaggggcttcagagaccaaaatgtggccttctttcagacgtcatgaacatcagctagactcacagacattttgacagacatatcagggtcaacagatccaaaacagtctcatcccactcccctgaatctagttctttcttgcctgtttactcttccctataaaagaaaattcctttatgcctgacctttgctatgcttgcagatcttatggctggagtattctcccaattacaacacctcctcccttactgcagtgttcctgtgaataaagtcattccttaccaa

SEQ ID NO: 6386 - DNA, 569 bp, Homo sapiens
gattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaagtcgcttattaagtagagtttatgtcgttttcaagatcattaactgctttggttctaatctgtttcttaaagggaaatgactaatataaagttgcttattttatatgaccaatgctatgatgcttattttatgtgatagtttcagagtattaaaaattgtcctcaataggccgggtgcggtggctctcgcctgtaatctcagcactttgggaggccgaggtgtgcggatcacaaggt

SEQ ID NO: 6387 - DNA, 470 bp, Homo sapiens
gatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaagaagacatgataggattgtgagtttttctctaactttggatgcagtgagatgaccagtgtgttccagttaaagaagaagagtgttttaaaatcataaaccaaataaagaatcctacctta

SEQ ID NO: 6388 - DNA, 486 bp, Homo sapiens
accatggcaatgggcagttcaccgagaagcgggtgtatctcaacagcaaactgcctagttgggctagagctgttgtccccaaaatattttatgtgacagagaaggcttggaactattatccctacacaattacagtgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggtaagcaacagttgggatgagatgtggaagattcattcattcattcattccacaactatttcttaagtgcctcctaacttgggaggatgccatctctcgtcgtgtggattcaatttgctttcgtatcttgctggttctttttgcaagtctcaaaattaagtctctaactcttcagggaccatc

SEQ ID NO: 6389 - DNA, 453 bp, Homo sapiens
tatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattact

SEQ ID NO: 6390 - DNA, 755 bp, Homo sapiens
agtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctattggcggcgtctaccccgggagctaaagatccgagtgcggaagctacagaaggaacggattacaattctgctccccaagaggccccctaagaccacagaagataaggaggaaacaatacagaaactagaggtgaggaggaagtgtgcatagagacctcctgagccctggatccattccctctctcttggcccatgtgtgcctcaatttttcccttctgtgaactgaacctgagtttctattcctattcatccccacatgagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcag

SEQ ID NO: 6391 - DNA, 576 bp, Homo sapiens
gttaataaggagaatagacaatatgtgatgtgagtattgaacagcactaaatcttaatgtttattgaaattactttgtttcattgcaggtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatga

SEQ ID NO: 6392 - DNA, 2256 bp, Homo sapiens
gggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtagtcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgccttttta

SEQ ID NO: 6393 - DNA, 7184 bp, Homo sapiens; identical to SEQ ID NO: 3713

SEQ ID NO: 6394 - DNA, 581 bp, Homo sapiens
ctcgtatgtgtagtctgatgctgtgtgagatgagtcatctggctgaaggttttcctgcattccttacatttgtaaggtttctcaccagtgtgaattctctcatgctaggtaaggtgtgccctctggttgaaggttttaatacattcgttacatttatagggtctctctcccgtgtggattctttgatgctgaatgagagttgattgacgagtgaagtatttcccacaatctaaacactgattgcatttcttttgtgtatgatttctcttatggagagtaagctgcatattgtggcagtatagatttccacattccttacatacgtttcttgtacattttatcactgtgtcaaactgcgataatacttcattaatagccctctttgcagataactccttaatctctgcacctggcacatctgaaaggggaaaaaaaatcaatgaacagaagcaaattaaactaatgtaatatacctatcttttatcttttcaatcccactttaggcacctactcaagaaactaagataccagtttttaaggttatattgataagaatgcttattgaaataggctttatattg

SEQ ID NO: 6395 - DNA, 4961 bp, Homo sapiens
cgcgcacccggagaaacagttttatacagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctgccgagcccgtgtgcccggagcgctgcgactgccagcatccccagcatctcctgtgcaccaacagggggctccgcgtagtgcccaagaccagctcgctggccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacaacctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgccctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagataa

SEQ ID NO: 6396 - DNA, 2133 bp, Homo sapiens
gcctgagtgcctgagtgcttgccttcacctggttgcctttcctcctcttccaaggtaaccacccttttgaattttttatttcacttccttttaaattttttctgtagttttattgtctatatgtaataaaataatattcaataatgcatgttttagaaccgtgtaaaatgatttcaggctgtgtgctcttctgggacttgcttatttcctaaacattgtggctctaggattcatccacgtgacttctcttcttttttttacttctgtgtaataatctattgtaagattgtatcacagtttattctccaatatatttggttaagtgctgttttccgctgttgtgactgttcaaatttctttgcctgtctcccaatggcacaggtgcaagagcttcttcagcatgtactttccagcgtgtgtcattctttaaatggctgtattgactggcattcccacccgcgctatgtaactgttcctgatgagccatattctctccaagagtggttattcttaaatttggtcttaaagttgtctagacttcttttatattttggatattacctgtgctgtccctgaaaccctctcccagattttgattttttttttttttgcattattgtatattttcatgaacagaactttaaaaatataattactggaagttattagagttagtccttttttgtggtggttttaagaaatctttttctaccccaggttaataaagacaatttgctacattttcttttgaaagttgtaagtataacatttcacatttaggtttagaatccacctggaattggtcctggtagatggtgtgaggtagattctactttaattgtccccccacatggatggccagttgtctcaactcttccctgttgatccgtgtgtgacctctgtcataacactcatacatgaagtgtttgtatatttctggttcttgactttctcttcttttcctattgggtgatttttatgcctcaagactacactgtcttatatactcgtaacttccccgtaggtcttgatatgtgggtgagcatttcatgttcctcacgttgtaatcctaacttagctgatttaaatattacatctatgtagatagatggtaagcgctttgtactcttcacttcaacatgtattaccgtaaagagagttgacttttcacattttaaattttgagcccatttgttacaattaagtctttctgagagtattttttataccctgtatttttctttcttttttttttttaaggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaa

SEQ ID NO: 6397 - DNA, 733 bp, Homo sapiens
gtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcaga

SEQ ID NO: 6398 - DNA, 459 bp, Homo sapiens
tattgctaattttctattattaattacttagtagtatgaaaatttggacttgtttcctcatttataaagtttatactttaaaaatatttgtccttttccttttctgaaaaatgttctatgtttttaggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggg

SEQ ID NO: 6399 - DNA, 1228 bp, Homo sapiens
agtgcagctttcagagggtccgggctcagaggggttatgattcggagggttctgccgcacggcatgggccggggcctcttgacccggaggccaggcacgcgcagaggaggcttttctctggtattcacaggcctccactgggctctcagtaggtgggatttgtcagcagttctcattgcctgagaacatccagctctccctcttttcagccagctttctacggaacatcaatgagtacctggccgtagtcgatgctcctcccctggacctccggttcaacccctcgggctacctcttgctggcttcagaaaaggatgctgcagccatggagagcaacgtgaaagtgcagagggatggaggacgaaggttggtttgacccctggtgtctgctccaggggcttcggcgaaaggtccagtccttgggagtccttttctgccagggagaggtgacacgttttgtctcttcatctcaacgcatgttgaccacagatgacaaagcggtggtcttgaaaaggatccatgaagtccatgtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtatgtgtatgtgtggcactgcccccagggaccaggcctagagactccgcttgttgcagacaccagtggagcctattttcgccgggaaggattaggtagcaactacctaggtggtcgtagccccactgagggattgttaaacaagtctgggcctgtccttgtgtcccaggcaatgtaagcgttgtccccacctctcactccagcaggaagaaccggacccggcgaacctggaagtggaccatgatttcttccaggacaaggtgtggccccatttggccctgagggtcccagcttttgagactctgaaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagaga

SEQ ID NO: 6400 - DNA, 3592 bp, Homo sapiens
actcacgcctacgtactcagtcaccagcggaaccctctccaccaggctccgcgtcgaggccctacggggcgtcaatacgcacgcgtactttgtgtcccaggtagctcgtctcttagccatgtacgcctctgcattccggtcactgggagcggggccgtgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgagctctgcatttccaggacctggtcactattcaggacacggttccagcgcagtgcgcgttagccatgtctcagggatgagtgacattccaagatgtggccattgacttctccaaggaagagtggggattcctgaaccctgctcagagagatttgtacacaactgtgatgctggagaattatcagaacctggtctggctgggactttccatttctaaatctgtgatttcactgttggagaaaaggaaactgccttggataatggcaaaagaagagataagaggcccattgccagatgtgccaggtgcagagattaaggagttatctgcaaagagggctattaatgaagtattatcgcagtttgacacagtgataaaatgtacaagaaacgtatgtaaggaatgtggaaatctatactgccacaatatgcagcttactctccataagagaaatcatacacaaaagaaatgcaatcagtgtttagattgtgggaaatacttcactcgtcaatcaactctcattcagcatcaaagaatccacacgggagagagaccctataaatgtaacgaatgtattaaaaccttcaaccagagggcacaccttacctagcatgagagaattcacactggtgagaaaccttacaaatgtaaggaatgcaggaaaaccttcagccagatgactcatctcacacagcatcagactacacatacgagagaaaagttccatgaatgcagtgaatgtggaaaggccttcagccgtgtctcagctcttatagatcaccagcgaattcatagtggagaaaagccgtatgaatgtaaggagtgtggaagagccttcactcaaagtgcccagctcattagacatcagaaaactcattctggagaaaaaccctatgagtgtagtaagtgtaagaaatcttttgtgcacctgtcttccctgattgaacattggagaattcacactggagaaaaaccatatcaatgtaaggactgcaaaaagaccttttgtcgtgtgatgcagttcactctgcacaggagaattcatactggtgaaaaaccctatgaatgcaaggaatgtggaaagtccttcagcgcccattcttctcttgttactcataagagaacacacagtggagaaaaaccgtataaatgcaaggaatgtggaaaagccttcagtgcgcactcttcccttgttactcataagagaacacacagtggagagaaaccctatacatgccatgcctgtgggaaggcctttaatacttcctccacactttgtcaacataatagaattcatactggtgaaaaaccctttcagtgcagtcaatgcgggaagtcctttagctgcagctctcaccttactcgacactgtagaatgtgtaatggaaaatttagcaaataaccaaaactcaaaatgttaattctgattattctgtatcatcaccagtactttgtactttgagtctttttaaatatgctctgttagtttgtatggaatgatatttcattgcacttttaatttaacttaaaaatgccttcccttgactgttgatatgtattttttgtgaagtgtgtgttgaagccttgcagattattttttaaattagaggtttatcactaggtatatctcctaatgctatccctcccccctccccctaatgtaaatgacgagttaatggtgcagcacaccaacatggcacatgtatacatatgtaacaaacctgcacgttgtgcacatggtaccctaaaacttaaagtataattaaaaaaaaaaattagaggtttttcttcgggtgcatttatgagagttcaccagattttggaaatattttctattctgtaacctaccttttcatttacataacagtgataaaagctttaagtttgatcacatccaattaatcacattttttaatagttatgcttttatttgtttttcagacagggtcttactctgtcacccaggctggagtgcagtggcacaatcatggctcactgcagtctctgcctcccaggctcaagtgatcctcccacctcagcctctcaagtagctgggactacaggcatgtgccaccacacctaatttctatattttttgtagagactaggtttcaccatgttgtccaggcttgtcttgacctcctgagctcaagcagtccatctgcctcagcctcccaaagtgctgggactacagacatgagccattgtgcctgacctagttctgctttttatgttctaagaagtattatttattctatgctgagcttacatagaatttcttccatgttttctatagctatagtgtatttttaccttttactgttagatctatttcatgtttttattatggataatggaggaggtaaaggttgaattatattttcccccatattattgacccatagtgacaccagttttgggagatgtctttcattttcgcccttacgttgttattggcaccttttgcaaaaatcaattatttatcatgagtatacttctgaaatgatctgtttcatcaatctatttgtcttctcagtagttccacattgtcttaattatagctttagaggaagtcttgaaatttggtagtaagtcttccagttttgttattttaacaaatttctctaggctgggcatggtggctcatgcctataatcccagcactttaggagccccagacaggaggatcacttaagcgcagaagatcaagaccagcctgggaaatatagcaagaccttatctctacaaaaaaatttagaaattagctgggcatggtggcacccatctgtagtcctaactgctcaggaggctgaggtgggaggattgcttgagtccaggagttcaaggctgcagtgagttgtgatcacaccattgcagtccagccaggttgacagaatgagaccctgtctcttaaaaaaaaaaaaaaaaatcctggtgatgcttttctggattaaaaaataaaataaaataaaaattggcctcactactctagcttatttgcattttctaataaatgttcagagtcaccttgtcagttcctaccaaaaagcctgtcggtattataattgagattgcatgaagtctgtagacaaacttgaagagaattgacacttaacagcagtgacttccagtctgtaaccttagcataagttctatttgtctcctttaatttttctcagaaatacctgtagttttctgtatagagatcttgaatgtattttcttaagtttattaatagacattttcacaatatgtaa

SEQ ID NO: 6401 - DNA, 654 bp, Homo sapiens
cttttcggctggaatggggaatttgtgaggtaggccggaagtggtgttgcggagggaagtgtggggagagcagaggcgcagctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaa

SEQ ID NO: 6402 - DNA, 764 bp, Homo sapiens
gtgaacactttcaggcaccagctgacttaatacagtttataaataactctttaagtttgcactttgtctagtgtcaactgtcaactctttacagtttctttgtatagactggtcttggttaagagacgacatcattaactgaagtcaaatcaactcatgtaaaatatgtgattatataggattaaataattatttagaaaagactgaatcttggttttacattagtgaaatgtggctatctggcagtggtagcataagcctagctacagcccttcctgttacatcaagccctaaaaggagttaactacaacttaatgtgtgtgtgttttttttttttctttttggtggggggcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagaggtgacattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtca

SEQ ID NO: 6403 - DNA, 676 bp, Homo sapiens
gagactagggagtctgtccgccattgtggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtttcagtacaaaacggttcgattcatcaaaaagatgctgtaaatgatgatgattttgagccatacttaagtagccagacaaatcaggtaagtcttctgacagtttcagattttaggaaattaaccttttattagtattagttgatttttcaaatagattatttaatgagattaaccataacatggattcattcatctagtgtacctatatagtaagtgagtagtgagtagcagttgcagatttatggcacaggagagttcttcttcagaaagtataggcaccagaaactaggttatgaaatatagaataaagatttgaaggtgaccattatttgtatatattatggttaggttttttgtgtgtgtgtatt

SEQ ID NO: 6404 - DNA, 14289 bp, Homo sapiens
aagcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttacaatttttatttctgcagtacttaactttctatattttatgtatattaaaacaagttaggtaggatgaagatcactggatgatataaatactaatagcaaaagtagaaataagttgtattatataagttgtacataggtgttacattaggttgtcttacatgaaagtattacaaagtatgggatttggggtgtattttgaaatccttgccagttctacttgataaagtattgaatggtatcatgtgagaggagaagaggacggaaacaggacttatgatttagacctcaacaactgctagggagggttggttttctctgagtgcatgattttttataaaaatgctattttgccagttttagatccatattaaacccacagattaaggttttggtttttaaagtgtaaataggaagcttgagctgggggggaatttggaggtagagataatacttaatcgctgtgggaaaggatgagatctagagatagagtgtatgtgggagtaggaacatatgtgtctgagaccatgctttggatgctctagcatttagatattgagaaaatgaggaagacccattaaaggagattgtggctagagttactggtgaaaaccaaagggttgtagtgttcctgaagatacatgaagagtgagattaaaaattaatggggcagcagtggcttttgcatggcattgaaaagacacagttcaatttgaaaattgagtatcattaatcgtagtgctcttattattgaaaaggccaaatcaaacaatacctttgagttgatggtctgtactataattaggttaccattgttagcccagcatagacacatgctgatacctgtgagttgctttcatcaattagtatgtgaagatgcatcccagttgtacaattttagatcctcttcatcattccacattatatgtatacaagataaaacttgatgttttcattacatcctttcaatcttctaacagcagtccttacgtagctttatcattggagtttccacttgcagtgtctctatctgtacctgcattcattggccacggtagagttttcattacggcaggattgcatttcattgttttggcttgtgtcagacatttagcaaagattgttgaggaaaggaatggatggaaggggccagctgaaagaaaaagtaacaacctaatgatggataagtgaaaaaggaatgaagaaaggatggtgctaggaatcgagggagtaaagcaagatagaatgtacaaaaggtcgaatttttaaagaaagttgtagggcaagggcaaggtgtgttgaacctacatttaaaatacaataacatcactaaagtcgaggccgggtgtggtggctcacccctgtaatcccagcactttgggaggccaaggcaggcagattacctgaggtcagaagtttgagaccatcctggccaacatggtaaaaccccatctctactaaaaatacaaaaattagctgggcgtggtggcgggcgcctgtaatcccagttacttgggaggctgaggcaggagaatcacttgaacctgggaggcggaggctgcagtgagccaagatcatgtcactgtactccagcctgggcgacaagaatgaaactctgtctcaaaaaaaaaaaaaacccatcactaaaatcagggagaaaaaaaccatcactaaagtcagggataaagtaccattgtggaaggtgttcttttccagcttaacctgaagaattgtacagtcattgtacattgtcattccctaactaatgggttagatatgagtctgtagaaaattgtttgtccaacatactttatgcctcttaacatttcacttaccaaatttcatttcattccttcattttgtgtctaacagactagaaataatgagctcctattgacagggatattttcctcttcatactttcctttaccttacagagccttttatgtagcagatatttaatttcataatgggtctaaactacttgtttagaccatggatgagtgaaattttgatgaatgagccccaatcacctgaagggtgagtaaaagaagaatttctagagacccaatatgaagtagctgcttcacacttttttgagaatgttatggcatgactgaggaaatcatagatgctgtagaccatgttgagttggattgtgtaaatatagattctggtattagggaactcagcatctgctggattagacttcttatggtgaaagtctttttttagggattaggcataaatccccactgatatttgtgcagtaatagagtatagctcctgttttctttcctgcttgtatagcctgtgccattagtgtcctctttctcactgttttctcaaaggaaaacagtcaaagaggaagccatatgcatggtagactttgtaatccgggaaaagtcaacatatttcatagtagtgcactttttatgtgttgtcagtccttagaaaggattcattttctccatattatatactactctattttaaaaatttcttgggggagaatggctgtagacaggccaatgatagaatcatagaatatagtcactgtctaattactttcaatcaagagagggaacaataaagtacaatgtatgtcgctgacttcagtgtgaccactcagtatttctgtaacacagtatttatattgctgtacggtagagttatacttatttctgtgatccagttcatttgtttaatattgggattcaaggagtgttgaagaaatgtctactgattaataacagatgggaagagtgtatgtgttttaaataagagaccaagagagacaataaggaaaataagaaggaagtgtttgtgaacctttcacattactcttacattcgggaagtccacaagacaccgtagtggagattctgaggaggtgaaaacctgtagaaaaatgctttattagtaaggagctgactaagttgtcagaaagtgttgatttttagaaggatattgagacattgggtatatagggtatatgactccttgtcttcctttcattctggcttcttaccagctgttgtgaataagtttaagatttcttctgacgttataaacttcagaaaaggtatggctgtttgttcagtttgaagtagtatcatatccgccaaagccttgttcaattgtcttgttgattcatggttctcttcagtgataatattatatgggattcctacccacagccacccaatatctcagtggagaaatgcaggtttggagagaacatctgaatagaatcacgctaagatggtacatttgcactgagaccattgttatgtggcaggcagacatgaagtatcctaggattgatcagtatgccttaatgtaaatagctgcatatagacctgatttcttaggctccccacttcaagctcttgaatattgtgttgatatccttatcaatacactttgtcttgtgttctgtgttgtttttccaaaatataacgagctcctacttgacagggattttttctttctattgtcttacgataaaatgtcaagataaaaatgtatgagtttcattaaagtttattgaataaaatttgtgatggaatgagtgacagcgaggtcatgaatgagagagaatatggaaataatggagaatgtgatattctgatagtcatgcaatattctttttgatataatatgtaacatatattagtatgttatattctatgtattatttgtcatatattattactatatcctgttgctatatttggataatttgggaatctgccatgtttgatgatgttgaaaagagaacataaaatgtagtgatttcttaataaggtgtagaggtgtaggtattaactctttaagaatatagtgatttattttaaaataatgataggaaaggaccataaaaatgtctgaatttgggaaattagaaaatgttttctctctggggctttcatatgtctgttctatgtgaatgtcgctttgccatggctccctctttgctaactcttcttaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaactgtgtctttttttgaagtcttcttcattgaaatatattgttactaaatatagaattaatggctttctttaagcacttcaaagataatccactgttttctggactccgttgatacttaagtctttatttttgtgtaattctttttctttaaatgtgccatttttcatttttctctgactcctacctactaagatatttttacctaagtattgagtcagttttggttatgatgtgactcagtgtgtttttatttatattgtttggttgtttgaacttcttgaatctgtaaatgttgtgctttatgttaaatttggggggatttcagccatttaaaatataacttttcagtctcttccccctgggactccaatttttacatatgtattagacctattaatatttttctatggatacctgacattctttttaaatcttatttttggtgtttttcactttgaacaacctaataatttgtttccatccatgttcactcactgtttattctattttttcccaatctgctcttaagcctatcctgtgaattttctttttaatttattttattttttagttccagatattttctgctttttgtttgtttttgagacagaatctttctctgtcacacagggtggagtgcagtgtcatggttcaccgcagccttgacctcctggtctcaagtgatcctctcaccttaacctacccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaat

SEQ ID NO: 6405 - DNA, 1845 bp, Homo sapiens
agcccctagcgcagacggcggagagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcagccaagcttcttgaaaggcctgtctacacttgctgtcttccttcctcacctccaatttcctcttcaacccactgcttcctgactcgctctactccgtggaagcacgctcacaaagggctaatctcgggccttgtcgaaggaagaggctgcagacgttaatgaggttagctgctggattccagtattcgtcgcataaggatccttctttgtctgcgaaggaaaaacacactgattatcataatgagttcctgacctggccatcccggggtgcccttgaccagccccgtgtctcctcagggtgtcccagcaccagcctggcacagagtggggctcagttagagtatgtgggatgttggtttcgccaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaa

SEQ ID NO: 6406 - DNA, 729 bp, Homo sapiens
ttttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctacctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaa

SEQ ID NO: 6407 - DNA, 3181 bp, Homo sapiens
gtgtgggctcggcggtcctgcgggcctctccggcgcgggggagtcctgggaagacgcgcgagccacaacttcagggggcgtggcgggaacgggagcccctaccgaatggggtggcagaagaacgaaggcgacaccaagctggccccttgcgggggtcgggacggcgggagacctcatccggagccctgggcccgcagagccaggagaccgcgccaaaatacatcagggaagaggggaggacggaataatgggcctggggacaaaggaacccactgaaagggaacccactgagggtacggattgcacccgagcctgagacagctgaaggtttgcagtcggtgacgtggcgaggtgggcaagggactccaactcccagcgggccccgcgcggcctgggcggggccagctgtccctggaggctccgcccattagccccggcgcccaggctccgcccgccgtccctggcgactccaagcttctcgccactcacgtcgctccccggccttccgtggattcgctcattcgctctgctaaaatggaatgactacttactagtagttgtataagatttttccctcgatttttgttccttaaacgtgggtaatacctaaccctagagtggttatggggatcgagcccgaggggctgtgcttgactgcttggcgcagtcactactcaaatgttagcttttctttaaaaacaacaacaaaaatctgttatgagtaccctgtccagttctgtgctcggcgacgaccgaatcagaccacgtccctcacaggccccacggtccactggggagagacataatcacaggctgtgctaagtgttaactagcgcacatccacagggcgatgggatatgaccatagcgaggtaaagttagcaagcaagggaagtcaagaaaacgacctgtgagcaacctgccattccagatggctggaaaagtgtgcaaagaggacagaacagcaaagacaaatcctgaaagtagaaggaataaaagggagccagtgtgggcggagtcgagtgaaggtagagaggagaaatagacacagctgtaggaggttagagacggagtccctacttctgtttcggatgttgactaaacaatgtagatagatattgatgtcatagcctggagagagaaattcgggagtcatcagtgtttgaatggagactggatgagctcacaaagagactgggacactcatccctttagcagtcacgacaatgagaagcaaccagcaaaggacacggaggagtggccagtgaaatggcagaagaacccgtaggcctgtccatgttttcctgcccaggggctcccgagggctgactggagcccagccttaaaccccaaatccaacctgcattgtggccaaacggagtcagtgctccctgaacacaaactgcaagttagttatcaacaggtacctccaatgccctgtcaatcacccatgtgaggacaacctggcagcaggaaggagaaaaaacaggagctgctttaatctcccggaatcctcacttctccccattcttgttggtccaaaccatcaagatctcttgcctgggtgacgtctcctaactcttgctgccttctctgtcactacaataatcaaaaccatccaatggcttcccagtgcctttagaattaaatccaaacttggtactgtggcccctgctgccgccccccaaaaaatctctctcccatccttcctgttctctacctgttaatgccttcccatccctcagaacccatcaggacacacgtgagtttgaatgccctgaattgtataagcatggagagcggtataccagggtgtactccagagtgagcaaaatgggaactcatgtcagaaagtgaaatgaaaatgtaggctgaaattctatcagtaatactgcaacaaaactctctgaaaccatctcacttaactcggtccaccaacttgaaagacactttccttttcatctgtgaagcccactgctggggctagcaggctactattatgactaagcaattccacttccatctctcaagctgtttacttcctgaaagagaagctggatgccacattgcaactgcaaggtgccctgtgaagaggcctgcaacggcgagaaaacaagggagacctccagccaacagctaggaactgaggctctcggccccatcacctgtgaggaactgaatcctgccaacaggcatgtgagtgggctggaagtgggccctcctcacggagccttccgatgactgcacagccccagccaccagctcgaccgcaaccccgagagcctgggagccagcagctcagccaagcctggattcttgacccccagcaacggttcgtaacggaaaacagctgttcacaagcgtgggtactcccaaacacagatattcaggacaactactggagatagttgtagaatctcaccatcttcacacagacttgtatttaggaaccagcgccgtattgcactgtagttcaattactatttatggtctgcattcacacaagaaacatctgccaacaaaggcaaactggacaatgtctgttccttctcatgagtctggattccgagagcctttgggggaatttggtcttcaaccccaggacgtaggtgaatacagtccgggccacctctttcatttctgaaagccgactgcagcacaggaaagagtaaaggttttttttccttgccggtggattccccaggaccaagcatacaccatcatacattcaagtagctgtttgtggacatccttgcggagaaatattcagtgttcagaacggtcataaccttgaccagaagtctttgactaaccttctcaggggaacccactgtggcttttgcctgatttaaaatgaaccaagttggttaacttgaacagttcagatttcttccacaaccaagtcacagagcttctgtgaaatctctcaggtcaagtcaccatcaactcactcgtgactgaagtccaggagcggaagtgtcgagagcatcgcggtgtgttctgttcagttgctcagaacaagtcaactcctgatgatggatgcaacgacccaacttccgtgtccttgccaaatgctgtcgccttggatcaaggtgtcctgccaagtccccctgtcatgacgctgtctgtagttgtgcttcggaactctggccagtctatgtgaaacttttctctcaatatac

SEQ ID NO: 6408 - DNA, 606 bp, Homo sapiens
ttttgtagagatgttctcacgatgttgcccagactggtttggaactcctgggttcaaggactcctcctgcctcagcctcccaaagtgctgagttatcaaacactgaagtggaatgatggtattgttttgccataaagcaagttttagatattagatgactgttttttttcccccttgtagcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggtaagtttgactcgtatttaagcttttacttgtgagtgatttgtcactgttagaaatatgttatcattagtcatctatagtacttttttattcaactgaagaatgtaatccatacattaactagggcaagtaatgaaaagcagccactttttttttatctgaggaaaggtcttaaggctgttgttaagagcaaagcaaaagcatctctgactttttaagacaagccatatgtttcagcttataacaatatgggc

SEQ ID NO: 6409 - DNA, 591 bp, Homo sapiens
gtgcgcggcgggctgtcgttggctggagcagcggctgcgcgggtcgcggtgctgtgaggtctgcgggcgctggcaaatccggcccaggatgtagagctggcagtgcctgacggcgcgtctgacgcggagttgggtggggtagagagtagggggcggtagtcgggggtggtgggagaaggaggaggcggcgaatcacttataaatggcgccgaagcaggacccgaagcctaaattccaggagggtgagcgagtgctgtgctttcatgggcctcttctttatgaagcaaagtgtgtaaaggttgccataaaggacaaacaagtgaaatacttcatacattacagtggttggaataaaaattgggatgaatgggttccggagagcagagtactcaaatacgtggacaccaatttgcagaaacagcgagaacttcaaaaagccaatcagtaagtttgttttgtgaactgaatattaaggagaaatgcctgtagattaattctggacatggaatgaacaatggagatcatgttggctgccctgcctataaaatgattcctggtacctttcagctgctgtgttacagctttgacttc

SEQ ID NO: 6410 - DNA, 3138 bp, Homo sapiens
gggacgccgaggggaggaggaggaggcggctcggatggctggctcggctctcgctcgctctccctcccatgggcaagtccggctcacaccctgcttctcccgctcactcacagcccccttggctctccctcctcctcctccttcccctgcgggatccgctcgccgccgccgccgccgccgcagacggcaagtcgtggcagccagacgtcggcgcgtaacccggcgctccgtgcgtgactccaggcgacgtcagcgcgcgctccgcgttccccacccctcctcccaactccgtggctcgcgcccttcgctctcgcgtccctccgttttagctgccgccgcggcggccgccgagcgcgctctttccgcccccttctcgcgcgtgagcgcgccctatcggctcctggcgcgtcaacattccgcgggccaggccttggggcgcgtctgaggagggggatgtctgtggcctctccgcccacacttcctccacccaccgcccacagcgccccagaaggacctattactcgtttggcttctgaaggccgaagccaggctctggcggggatagaaccctgaagggcctgcgccagctccaacttagggccctgtgcgtcgttgcgacttctgctaccaccctatcacgcggcacccccgccccaactccgcccgggtctctgaagaggcaataggcctttcatctccggggaaagtctcaccttggccctcagacacccgccaagaggggtcggaaggacagaattagcatagagaagagtggctagagcacttttcaggctctggccccaggaatccttgacaggaagcgtggggttgctgcccagcctcccacgcagtgtaatatgttgaagccgggcccctttgagggaatgcgacttccttgggccgagggggaaagggtaaaagttaattttcataaaatgctatgcaagggctaaatgtgaaattataaaatgtcctttaagacagtcttcttgaaatcgtatcaagtttgacaagatttttggtgcacggtaacgcttttgctcgctttctacgctgtcacgtctccatcctgcaacactgaatacgtagatggaacgtggatcagctaataactgcagcaaaataaaaactgcatttatcatctttatcattatttaaatagacctccgagaagtcaaactgtgatttaggaaaacttaatcattgcctcaacctatttaactattttgttttgaagttactttgcaaatataccacaaaatccctctttgttaggcagtggtagacttttaaactcacttgttagagaatctttcccagaagcatatctagttgagcctgcgaggcaagtaggactaaggtataattactcccattttacagatgaaaatttagttatcaaaatgtaagtcagttgttcagcattgtgaggagtctatcactgataaagggaaaactctaaggtctattattgcctgctttattcactaaaccagaaatctctcaattgtttttttccaagtatcttttgctgcctcttacgtattgtaggcagtgcctgatggctgagaagaatcgcagaggactagaaaaggtttgagtctgaaattatctggcacagaggattaaagctcagaaataagtgattgcgaaacagttcaacttccctgttaatgacaacaacaacagcaacacgcttattaattcctagctggagcatcaagcttatgaagatttccaagactttattgttgacccttgttgaagagaactctacttggcttctttcctggctttcctaaattgttcacatacaagataaactaccgtcattcagacttacagaagtgagaagacaagctgaaccaaatgtaaaatggtagcaatttacagatgtcagaactaacatgtggatgaacttagagatggagaagaaagctgggcttttccaaagagtggatctatctgaactggatagcactattgaactttgttgcatattttgtggtagctctaaaactcctctgcttgcttacatacaaccagacaccagtgccttctgaagctaatccaggccatttttataacctaatgcagtagcactttgcaattagatgaagaagatcggtgggatttctttctgtggtgattaaaatgtgtcaggggaagaaatcaagacaatactccaagtgaaaaatataaagtcagttatttctttaatattttgtgttatagtaatcatttttatattttgagcatactttttcttgtctacttaaatactcaaaattaattataaaatgtaaatgtaagcacaatgagataccatctcatcccagttaaaatggcttttatcaaaaagatagggaataatgaatactggtggaaggatgtggagaatggggaaccctcgtacactgtcaatgagaatgtaaattagtacagccactatggaaaactgtatggaagtgcctccgaaaacaaagtagaactaccatgtgatccagcaattacactagtgggtatatattcaaaagaaaggaaatcaacatattaaagagatagctgcattctcatgtttattgaagtcctgttgaaatagccaaaatatggaatcaacctaagtgcccatcagtggatgaatggttaaagaaaatgtgattgatatgcaatggaatattattcagccataaaaaagaatgaaatcctggcggggcacagtggctcatgcaagtaatcccagcactgacctcatgaagacagagagtagattggtggttaccagaggttgagaaggggagaggagaggagggatgaagagaggttgattgatggatagaaatatacagtttgataatgataaatcagtagggtgactatagtttataataacctattgtatggttcaaaatagctaaaagagaataattgaaataacgtaagacaaaaatttaagatgatagatatcccaattacactgatttgatctttacaaattatatgaatgtattaaattattacatgtatccccaaaatatgtacaagtattttgtatcaataaaaaataaaatttaagataaagtaaatgtaatgattagcttatatttcctagatcggaaataaatatttacttaagta

SEQ ID NO: 6411 - DNA, 2271 bp, Homo sapiens
gcgcgcggcggaggggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtagtcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgccttttta

SEQ ID NO: 6412 - DNA, 699 bp, Homo sapiens
ggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaaccttgggttttacctggatttttgtcattgacagctcaaaatattctaatatagaagtatacatcattaaatcaa

SEQ ID NO: 6413 - DNA, 1124 bp, Homo sapiens
aacaaagcagcgccctgcggaaggcagccctcgtgaactcagaagttagttttcgtctctggacctttttataatcggacttcagcccatcactgtctcgttttgtcctcagaaacggcgacagcagcctcttcccaatgttgagagcaaaaagtgtgaacccagaaattccgagacagatctcaattacttgccaaggttgaggacgcgcgcgtgacagcctcaggaagtcctcacgacatgtgcccaaggtggtctgggcatagcttagttttatacattttatggagacatgagacatcaataaatgtatgtaagaagtacattggttctgtttggaaaggcggggcaacttgaagcaaaggcaggaagacgtgaagcaggaagggggcttccaagaaacagaagagacaagtgaacatttatttttatgtctttcttcctatgtgtatttcaagtctttttcaaaacaaggccccaggactctccagattcaattatgtccttgggcttggtcgactgctgcaggagtcttaaggagccttgtgcaaatgctagagtgactcatttaccaacattaaaccctaggatagatgcaacagagaagtactacttcctccatggaatgtgctgatttcaggcgacgtggcacccaatgtagaaaacgctggaatttttccttggaactggactgtgatgagaggtgcttgccatgaacataagctactgtcttttttttctttttttgagacggactttcactttttttgcccaggctggagtgtaatggcgcgatcttggctcaccgcaacctccgcctcccaggtttgagtgattctcctaccttagcctcctgagtagctgggattacaggcgtgcgccaccattcccagctaatttttgtatttttagtagacacagtgtttctccatgttggtcaggctggtctcaaactcctgacctcaggtgatacgcccgcctcagcctcccaaagtgttgggattactggcgtgaggcatcgtgcccagcaagctactgtcttttctttgaccctttccagtttttgaagataaagcaggaaataatcttctctgaaagtacttgataaaaattcccaaaacaac

SEQ ID NO: 6414 - DNA, 933 bp, Homo sapiens
tctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 6415 - DNA, 574 bp, Homo sapiens
gaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggtatgacttgcttccctatagccagttctgcctccgagcaacctattcctcatagtggtctaacaaattcatccccaatgagttttgagtctgtgtttttggtggtttggagcaagacccatcagtttttattta

SEQ ID NO: 6416 - DNA, 764 bp, Homo sapiens
gatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaaggtaagagttcagtgaaggggtaattgttggtttatatttctgctctgcaatttttacttaaaatgtaaactctgaaatattttttgaaaatggtcttttacagttacttttaatgtcatattaatttatgttattttgaacatcagtttacctagttcatagaagttaatgactgaattgttttttaagttatgtggaacagagcagttttcaaaactaaagtaattacaacagaatatgcaatatctccaataaaaagataccagttgtcatatatgtaccttacatgactgctctacaaactcaggctaggactgtagtggctccttttttatcaaataaattgctttagacaatccatccttaataggagaaaatccagtatcttccctgcttcttctctgcagctcccataagttaagagccttgggggccctgattgtaagtttcttctaagtgccaggctgagtgagaaggtctggtcagttgacactgactgtggtctctgtagcttggttctgcacttctccttggatgattat

SEQ ID NO: 6417 - DNA, 659 bp, Homo sapiens
tccggctggtctgtggggtttcgggttcggggtttcctggtgggcgtcaggggcaggcaacagagtggcggccgctacggccctgtaacagggccatggagaagctgcggcgagtcctgagcggccaggacgacgaggagcagggcctgactgcgcaggattcacagattaatctcttgaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttg

SEQ ID NO: 6418 - DNA, 1743 bp, Homo sapiens
gacgccgccggcgggaagggtccgcgcgccatggctggccgctcgcgccctttcccaccgctgccgggaaaccgaggctcgccccaaacggatttgcgtgaaaccagcccaaggttccgggcccccccaaccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcaatgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaatttcgtgtaattctaatcacaaaatgacgtgccttaagtgcccctccagctgtgggttggcagtgtccagacagggagggcccatcaccgaaatcctgaacgattactagaccaattctattaaaaacatttcaaggca

SEQ ID NO: 6419 - DNA, 784 bp, Homo sapiens
cgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagcctcgtggtggaacatcggacccattcaagaggaaggatgaaagctctatataggaacacgatgtgaatggaagaaacctgtcattattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggcactggtgaggtggattgatgatgaatcttctgacacacctggagcaactccagaacacagtcacgaggataatgggaatttaccgaaacccgtggaagcctttaaggaatg

SEQ ID NO: 6420 - DNA, 619 bp, Homo sapiens
cacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 6421 - DNA, 746 bp, Homo sapiens
aagatctcactctgttgcccaggctggagtgcagtggcacaatcacagctgaccgcaaccttgacctcccaaggctcaggtgatcctcctgcctcagcccccaggtagctgagacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagcccttgaagataaggatggtcaaacaaaataatatcatacctggagaaactcagatcttgctaagatttactggttgggaatccaaagttaatgccaagaagcagccgccagttgggatcaaatgtgagcctatggatcaagcaggcctagcgtcttggcagtcatggtgacaatgacgttgaaggtgggggctccaccgatgctcttcatacgaagatccgtggtcaattccccatcctgcagcagtgagtccaggaccacagtatatttctggccccccagtgtcagcccattcatgacaaagcttgaccagtctttgccaaccaggacaccaacctcagctggcgtgatgttg

SEQ ID NO: 6422 - DNA, 2437 bp, Homo sapiens
ctaagcttattattctgagtttgaacactggattcgtatggctaacgtcagtgaatcaaggatcccaggggatgccaatggcagggcacctcagttgtgtatatgtggggaaatcaaatgctacctgactcacatctgtatcactcagaaacattatgtaaaaaatatcaaagcaagataagcagatgtgtgatccactaccgccaaagcaaatactccttatcgttagtgtccatgtgaatgaagtcctatatagatcacaaatttttatagacaaatctaagacattgaattatttcttctatatatatgatactttggtgtactgtgatcttgctgcttttatccatatgtcagctttggttcttgtgagtttacctgcttattatgatacttggagtccattcatagtgtggggaagaatgatttttgccctgcaggagaaggtctaattgaaataatgctgcttgtccccaaagaaattgtttgccttgtactcttgttaaccttagagctagacctgggaatgattcaacttcaagccttaacctggaattttctggatttgagggaattcccaagcctatgatctttttcacattttctttttcttatatgaattttcttttctctcttttctggtgatagtctttaaaaatagagattgacagtgtatcataggattaccctctaagtgtgaaaatgtgtaattatgtacggtatttagaaaaagcccttatgtgtccattttgtcaactgaatacatttagattcactgggaaagtcagagaaatttattctttagtatcaaatcaaaccgaggcttttgccatctttggaagaaaagattattcataacccaatgcacaaaggtttaatttgagctgctgcatacgtcaccaaggggacactaggtgaggccttcaaatgattactacaagtctgtggcctgaggttattttaaaattaacaatttcgcatatagcctatatgacaacagagtgtttatattttatacaaatatctgctaaacatgcacacatatactcacacacacatatatatattagatgaaatgttttatttatgtataaaacatatacatataaaacatttatatatatggctttattccacagggcacagtggctgtatagcctcaaaattttaatataaaaaagtgtatgcatatatacacacacaaacatgcacaaattatttaacttattttgggttaaaatatattttgaatgacaatatatggagtagcaaaaacagttaaaatgacttctctttaagagttatccagaaaattaattgtattaggtcaaaatgccctttatttcacaggtctgtaagttaaggctatggttgctctattaccatatgccaatcaatactttaactgcattctgtgacagactgttaatatgaggactgcagacaccaagtggctctcctttgcagtgtttatgaattacatgcatttgagctatcaatttttttttcttttttctcaggtggagtgaagctgacagtacagtagatttggagagtaatacaaatcctttctttctggttagaacacactgccaaaagccatctctttcatctaaggaaaagattaaaaatgcatgttgatatctcctaactatcacacaacttccactattacaatgaaaaatctgttcccctttcattgcctctgaaaactctttgacgagtagatttcaaaaacagagattttaaaaatttgcttgctttactggtgaaggacatttgcattttttttttttatttatttaaaggaattagtttgttctcctggctcattcctctttgttactttctgttccaatacacagaaagcttgatcatctttgatcagcagaaatatcttttatttagcaaagctcaacttcccaagagttatgcatggtgtgcctatctgaaggtggtgttagctctgttgaaatgcctgggtctgagtaactgtcatgatttttatgattaaaaacagactcttcatcaagaataatgactaattctaattggtctttgtgatatgtaagataactcataaatgaattgcaatggattttatttcgaattaactatatatttatcaaagaggaactggcagcaagggtttggagaatatttttaggtaccaaatagcatagtgaggattcaaccaaaagatgaatttataagcagcagtgcccatcacctaagtgttttaactaacaggttttaaaaacattttatttacacaaaatatcagggctggataccttttaaagaggaggctcaagtatcgggctgtcatttccaatagatctgaccttttcttcagatacataagcattattttctctgtttaggtccaaggaaaaacaaaaggtaaaggaaataaagggaatatacataaggcaaa

SEQ ID NO: 6423 - DNA, 2339 bp, Homo sapiens
tctctctctctctctctctttctctgcttcagtttcattgatttttattgatccgtcatcaaattcactaatcctttcttctggtttatctagtctgctattaaatctaaatctgtgtaatgggcttttaatttcagatgtgctttgtaattgtagaatgttcacttggttctttttatacattctgtttctctgttgaaattcatcttcccatcccatgttccttccgccatcttttcctcttattttctttttaaaatttattattatttttttctctagcgcatatcagccagatattttctttaacatatttataacagatagtgtcattgcctgttaattccaatactgcatcatctgcaggtctgcctctgtcggctgtttttccccttgtttcccctttaaagtggttgtaagtcacattttctgcttctttgtatatcttaaatgtttaaattgtatgccagacattgtatataaaaagaatgtagaaaccaaagctgaggtttcccctgcagagtaagctgctctttcctgttaggcagttcgattaagggcttatcacctcaattcaaccattaattgatctaggttggggcaaggttgtaggtttagatagacttagtttatcttgagtttcaaatttcttgatgggaaaaagtgtttttttttttttttttttgagatgctcaccctgtcgcccaggctggagtgcagtggcaagatcttggctcactgcaatctctgcctcccaggttcaagcaattctcctgcctcagtcccctgagtagctgggattacaggtgcgctccaccatgcccggctaatttttagtagagacagggtttcaccgtgttggtcaggctggtctcgaactcctgacctcaggtgatccatcttggcctcccaaagtgctaggattacaggcatgagccaccacacccggaccaaagtgttctattttgactacaggtaatctccctccaatgatatgccctctcaagaccttgtgactttggatgattttattctgcatttctagcccagccttctgcattcagaaaagtcccatagggaaaaccagatacacattcagggctcctccagattcttgtctatcacatcaattttatttggccatgtgtagctcttctggtttctcttcctccaactagggtgactttgtcttcggcgagctcgatcctaagcccatacctagacctggcagatacccctaggaagaaaaatggacactggtgtctactcaccaaggaaagactcttacttttctggaatttaaatcctattgatctctctgtgtccatagctctctgatgattttttaaatgtgatatttgtaaatttttttcctagttgttaccatggaaatgatggtctgcccatatcttctgtaaaaactggaattagaaatcctttaccatataactttctgataaatgtatagctattttctttgtacaagagaataacaagttctaacaaaagctatgtgacatttcttataatttcttgattattcagcttttaacttaaataacacatgctgtgtgatcattctgtatttataaaattggacttgttagagccaagtgatcatttaaattgtatctgcttggtaaatgcaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgt

SEQ ID NO: 6424 - DNA, 4810 bp, Homo sapiens
agacatccattctacaactctgatgctggcacattttttatcttggcaaaaggacttaatagaaaaattttagataacaatcaggattcatactcttctcaatagtccttaaatggtttattgaccaaaaagtaaagaagtaacagtccagtcatatcatggaaagaacaaccaaattcatgcatgcacaggcaaagacaaccatatcactatgaccacctggctgacagtaactgcaggacatcaattattgtaagacacttcctgtaatatgtttaattcctctgacataaggatttatgtgaattaggaagtggcccaagggtgaaaagtaatagggaaatagagaaatagaaccgatccaaaggaaagggggaaaaaaacccacaaaaagtgtgatgtcaagcaaagcctattctggagatgactttggttcactcccacgggagagccctagagacaaaaaggttctacagtaggttcaagtcagaggccagagaacccagagtatttatacctctgcaccatcagttattgaatgggggtgggggtgggggtgggtgtaaatttccaggtgcttccagcctgcaatgcagtcaaagcatgttcctgtagcctgaggacagccgtccaacaaagaggtgcaggtgctgaatgttgagagtgaaagcacagggagctgtcatgcatgagagtggtagagggatctgaaagtgctagcagtgcctattatacatccaaatactaaagacgcttagatgtgaaaaatgtgtgtcttagaatcgataaaatatggtatagagaatcaagtctccttgttcctggtttatctcatagcatacttaaaattcagctaaagatgaaatgccttaacaagtgaaatgggctttctgaaaaattatttcaatcaaaattgtgttaaaagctatttctaaaaaccctaacatgaaatacttagaagagatcaagtggtttgtccctggacattcaagcaattgaatgtctaaacaatccaagacagataattttgtagtatttactgtgtgaagtgaacctttaaggctgtggacaatgcaaactccctcatgtaccttgctccttgccaatttcaaacaaaccttctcacctatgatataaggcttccttagaattattgattaattatttaagatacaataaaaccaaagtatttttaaaacacagtaattatgttagtgcaggtacatgacatagatatcctcaaatattcttaggacatctataaatcaccacaaacattctggaaagcagtcttggaacatctatcaaaggccttaaaaatttcttcttctgtgaatttatcctcacaaatgaccccaagtttagaccaaaataaaaaaatgcttaaaaggcttattaaagcatgatttaaaatagaaatgattgcctaaattcctgaaaacaggggaatgtctaaataaaatatggtatctaacatgatagaaaatgtttactaatgtttaatgataccaagaaagtatcacaataataacatcaagtggtaataacaggaaacagatctgtatacaatataaaaccaacagtattgtatatataaacaccatagaagatctgaaaaaaaattagatgacattatttgtgatatctattttatttattatatttttctgcatactactctacagtgagcctgtcctttataagaaaaaatgctaatgatttattgtgtatgaaaaaagtgtatctgatttgattatatatttttatttccacttatattttctaggattattttgctttagaattctatgtataatcctgtgaaaatttgtagtgttgtagggactggaaagatcagagattatgttatggccatgaatgaggcctgacctgcattgtcaataactaaattgattattgtggaaacaacaaaaaaattcattttttgaaatgaaaatctttattgaaataactattttaccattgtgtggtcagattcactgcatttgatgctttttcaggatttgtttttcctgctagaaatgctagagttgtcacagatgtgatatttatgttttcattgtctggggagggccaagtttcatgacagagaaagactggggccaattctgtgattatggatgtcaacttatctcagagcagtatcattggttgagcagtcctgcaggacatctaagtttaccgtctttatcttgccattgtcaaagatcctggacctatttttttctgccttgaaaacttttgtgcagtaaaaccagcaatggattttagcagagttgatgcatcattaggattttcacattaactctttggacttagagccatgtctaaagtgtccttcttttggatatagtgcctggtgcagaactctaccacaaaacatcaggtgtgcctctgaatagtctttgcaagaagcacaaaatcctagaattgaggtgaatttgtaagttcctctagtccaaccacctttcaaatgaaagaatccttccaaagcacccctggccaatagctcatcaagattttgcttagatattcttattgagggggaacttactaactcctttaattcttattttgcttaaggctgagtttttaaaacatctaacatcagccaagattattgatttatctataaggaataatctgtgaattaaccttctgtagcttttccttgctgaccagggaatacctccccattgaagcctaggccagattccagtccgttttgaccataccccatcatggtattttagagtacacctgaataagatacatggtgccatgtacatggaaactgactgctctcatgttacgggttgaactgtgtccccccaaaatttgtatgttgaagtcctaaaattggcactgttgccataagccagggaactacctaggagatgctaggagagaggcctagaatggaaccctccctcccccgcccctggggccttcagagggagcggtgcccagctgacaccttgaccttggacttctagcctccaaactgtgagacaatacatttctgttgcttaagccactcagttagtgtgctttattttggcagtcttagcaaactaatacatcccccaatccagaactgtcctcctttggataataaaaacagcaataattatagtgtcattaccctgagtgactggtcccactgttggtcattctttgtagatgtgagttattgccctattgagatcagaagtcctctcacttagaggcatatctaagacttttttcttgtggagggagctcactcaactgtaggtaaggtttgactcatctgggttagtagtaagaacaaacttccaagtggcaccatcttaaaggtgcaagcccatgtgggcgatgaccaggtctggtatattaagaggctcttggtagcacattagaaacacctggagagattttaaaatttacaaagcctagccaaaccccagacccattaaccctgactctctgagaataggaccctggcacctgtgttttaaggattctaggtgatttcaatgtgtagccaaggttcactgccatagcctgtcctggaatgcaggtaactaaaacttcagcagattatgaaaaacaaaagttactttcttggatgcatatattcttatagcctcaaaactgaaactgcaaactgaacaatgctgcagtcagatacacacacatatttcaactgcataacttcctttaataatacttttatttttccaaatttgaagactgtccctaagtcatttcttctaaaagttagtaataatcccaccaactcacatttacatagaagttacagtttaaagtttgcatctcgtaataacttggtgagatagggcaagcattatttctaatttgcatatgagaaaaaactaaggctcggatgagttatgtgacttccctgagtcatgttagagtaactaactcctgatttgtaaactgaaggtcccaaatcctgggaactccctcagctctgggcaagccaggacaggtaggtcaccctgcacctacacaaggactgagctgagttctagttacctgctgtgaaggactgtagaggttatctaagccagctcctccttttactggaaaaggaaaagactgagataagtttccaaaacccctgctggagcaccttctacttctagaaagatgttgaggggcttccagggcacaaaggaaagagaagtaactgtgtctccttccccaaccatgtatgtgatacattcattctctaggattggaaattcccagaaagctgtgtcagcaatgagatttgtttcattgttttgccttgttttgtcattgagttgttatagttaaagtttattattttttaatgcagaaaaaagtgacttttgggggagtgcagagttctatgaatttttaacacatgtctagttatttgaccacaaccgtaatcaagatacagaacagttttatcatttcaagtgctctcctgctatgcttttataacacacccttccccaccccaactcctggcaattactgctctattctccgtaactgtagttttgccttttcgagaatatcatataaataatcatgtattatgtaacattctgagacaggcttctttcacccagcataatgcctttgagattcatccagatcgttgtgtgtatcagtagtttgtttttattactgggttatagttcattgtatggatataccacagtttctttagccattcacccactgaaagtcatttgggttgtttctaggctttggtgattatgaataaagctgctatcaacatcca

SEQ ID NO: 6425 - DNA, 2025 bp, Homo sapiens
ctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcaggtgagttgcccctgcttcatagcccccttccccttcccagaggttgagagccccccacgcctgctgctgcttctctccttgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacaggttcaggatcggggtgggcagggcgagagcttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgatgttgcagctcccacccgtatccccaaacaccaagaccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaaga

SEQ ID NO: 6426 - DNA, 535 bp, Homo sapiens
gatccgccatctgcggtgggtgtctgcacttcggctgctctcgggttagcaccctatggtgccttctcttgtgatccctgacctaacctgtctcttccttttcctcaacctcaggtggagccgccaccaaaatgcagattttcgtgaaaacccttacggggaagaccatcaccctcgaggttgaaccctcggatacgatagaaaatgtaaaggccaagatccaggataaggaaggcaagtagtattttgtagttaagaaaacttaacctgcggagacttcggcctacctgtaggtgctagacatacctgctcttggtgatgggggaaggggtcagattgacaaagcgaaatacttgtggaataacacaatagacattggtgatcggggagcacagtacctagattggaatccttgaggtgtatttcacttgcgtgaatttggacacttatttatttattttgtgtgagatggagtctcctctgtcgcccaggctggagtgcattcgcttgtcccggcttactgcagcctccgcct

SEQ ID NO: 6427 - DNA, 1305 bp, Homo sapiens
agacacacctttgatcttgctgaaagatggactcagcatgtttgctctaatgactaagtgaaatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattgtcattatttagaagcaaggtccttgaatgagcgagattatcgggaccggagatacgttgacgaatacaggaatgactactgtgaaggatatgttcctagacattatcacagagacattgaaagcgggtatcgaatccactgcagtaaatcttcagtccgcagcaggagaagcagtcctaaaaggaagcgcaatagacactgttcaagtcatcagtcacgttcggtatgattggttttgttttcaatttgagtggagttttatttgtgtgtactcttaacgagctgataagtttctaattttttatatatatatatataaaatactatttggatatattataattgtatttatattacttaaatccttaaaggaaacctccaaattcttgtagctgatctgtatatttattagctagccctcatttgcccacatttcctcatattctgcagaccagataatgagtttattgattttaataataaaactatttttttatttgtaacatattcttatgaaaaaatcatgcacccatatcttttctttcatcttaagcattttttttttcttagaaaccctttatctggtacttgaaaataaatgtgaaatattgcactggtggacacctgaatgttactaacctgcatagagcatagttccatagtccagtgcatcattgtctgcaatgaattcttttgaagttgtgaaaatgggtgctgaatgggaaacatccaaaaagtctgcccccccctttttttttttaacactcagacatcttcacctgcttgaacagtgaactttgaattagtttctccccaagttttcttcagtaaaactagtttttattagattgaacattgaaattaactagcctttattttccccttttattttaatcatgtatattttaaaatattgctaaattagaataatttcaaatagtcttgacattttaaaacatttttctgaaaaactagacatctcaattcacagcatatgctgtttatagcaagagataagtaaatcatgacattgcattctttaaatttcagacttcaattaaatcagtattttaaagagacaa

SEQ ID NO: 6428 - DNA, 1123 bp, Homo sapiens
ataaaacttgcctaaggttacacagccgagtttttcagttttattcttctagagcacaattttccggcctgttactgagtacggtcttctaacaggtacacaattaactcataagtagacaacacaatggcagtatttgggatccgccggataagctgggcaaacagtcctctataaaaggcgaggtagccttcttcctggaacaccaggcgcgccgtctggacaaaagacttgtacttggtgccctcttcccggagcctcgtccttataacttcgtgtggataagcaatgcaggaggcacagcccttagaaagagcagcagctgccataagtccaaaaaaacttgtggaatttttctcagtcccatttgcagaagaggctaatggagcttctttcagatacttctttaaactttcataaatagcaaagcagattatagtttcggaaattccagcatacgaggcagttaatcctctatagaagccacgaatgccttcggtctggtaaacgtaacgagcacactggagtgtattcacctgcttaaagcccctcactttctgttctagctgcattcgggttttaaccatccatataggattcattaaggaatttgtgataaaagctgcagagccagctgagaaaatatgcacaatattgctgttaggcacgaaaatgccattaaattgctctttggctttggagtaacatgcaaagtatacagcccttgatggtgcaactccaaccaaatttggacccaagcctctaaaaagtgactttggtccctctttctccaagatcgacttcagaacctgaaagagtccaggtgtcacggatgttggtctcaccattccagctccactaatggtccccagatgaacctgaggatagtagactgtccggagagctaatcttaaagactgcaaccgtgtcttaatgacttctagtggacaagtgaaaatagcaccaactgtgcctccacacccgccggcgaagaggtgaagcagcgtgttctccttctgctggccgcccgtcgccatggccgcgccggctccgcggcccgtcgccgcccggtggcgagagcgcgtggcggctcgagggatgcgcggaggtcgccgggtcttgt

SEQ ID NO: 6429 - DNA, 2945 bp, Homo sapiens
actctgcgccgaccggctgggcctggcacccgcgggcggccccagcctcagtctccagctacctttgcctcctgcggccgcccccaggcagagctgcgatcccaccgccgggggtgcagggagagggaagatctggcctccttggtccttttgcgtgggctcttcagagcgtgagcgccggggagggactccggagaaaagcttggggggctgcgtattgctgctccccaagctgggcgtcaggaccaaccccgccgcccccacgggcctgacgggagaggaggaagggctcgggacggtcggctcgccgagccaaccaggtggcgcctgaagagctgtccatggtgtcgacagcccagcaaacggcaccgagttcctagtctgagtgtctggataggtagcagaagaaaaactaatgcctgctctgggacagttctgttcggtgccttttcttgtgtgttctggagctcacagggttctatcgaagagtgcttaggtgtatacgatggagagtgggacgtcacaaaccaggatctcaaggctgagtccaacaaaacatggccgtagggaggccacgacagctgtggttgtcaccgacggatgaatagcttttgccaaccgtggaatttagtaactaaaggcacctaacccttttatctcatcctcatttttcaacaaatggtgcttcctggctaatatcagcgtgtcccatagatttctgcttccattgaatagacctaataagaaagagaatgaagtcaaagccaacagggcagaaagaaattgaaaacctgaagaacccagcactcaaactgtctccacttgcgtttgctttttctttacctcttctccttctggttttcaacagccaaagcaggatttaaatttggttatgttgcaaaaatcatttccctcttcaggccctgtcatgtgacttgattttttcgtccattttagagaagctgtacccaccctggtttcaggacacggaactaaatttattagaaaagaagccacttcaagtcatgaaggagaaacacaaagattcttggatttagttctaagaactagaggggatttctatgtcagtactgtctcagaaaaaactgttgatatcaaatgtgttgcttgagaagtacctttttttttttgagacggagtctcgctctgtccgcccaggctagagtgcagtggcgcgatctcggctcactgcaagctccgcctcccgggttcacgccgttctcctgcctcagcctcccgagtagctgggattacaggtgcccaccaccacgcccggctaatttttgtatttttagtagagacagggtttcaccgtgttagccaggatggtctcgatctcctgacctcgtgatccacccgcctcggcctcccaaagtgctgggataacaggcgtgagccatcgcgcccggccgagaggtaccttttatgacaactgaaatcattcagtttcaagaggagttgggtactgaaaccaaacttgcttactccaaagcccaaaatcctttccaccatgcctgtgtgtctgtaaggctacactagaaatgcttcctttcttatagtgggaagcatgggtactaagctcttttacgaacaagtgttctgcatattcctggttcctttttattttggactgaggagatttaggtcaaaatttctgggttctgggttggaattccagcttctttcttcaaattaaactggggggtagcaagacttattcctagatttgttagaaggccacagcttttccacatctcattttagtcatgaaaaagacacatgcccagagtttgaaaaacataaaggcaatttgactagtggcttgattggttctatcttctttttcttgtccctctttcctatttatacttctacttttgttacagcatttgacaatagttggaaaaattttcactgaccttgaaatgtctttgggatagggtgacttaaaatataggttaagtggcatacacaaacttcttagtgagatcctaagggcctacagagacaggctgacaccaactcaacccttgaaactgtgcaatgaagagcctgtgggaggctaaaaaacgctacttcaaaaagagatccttgtctgtgaatgttaatttaggtttacagatttgattaagggtcttgagattattttcaattatccaggtgggccctagagccctagatgcaatcataagtgtccttataacagggaggcagaggaaaattaaacacgcacacaggagagagagagagagaaaaaaaagtgatgtgaagacagcagcagagattggagcgatgtggccatagccaagctatgtcagcagccatcagaagttggaagaggcaaggaaggatttgagcctagagcctttggaaggagcatggccctgttggttctggcctccagaactgcaagaaaatacatttttgttgttttaaaccacccagttcatggtaatttgtaacaccagctacaagaaattaacacaaggctgatgtgactttccatcaggagagagacagccccaggtgagacctgcctgcctcattgtctgacagctttcccagcctcctccaggctcccctccgttttctcttatacgcattcccccaataaacttcctgtacatttaataccatctcagtgtctgctcccaggaggaccctaactgacacactggggcatttagcctccaattccttttctcccttggctgagatctgttccaggaagtatctccaggacactccagcctgttgcacaggccaaagaaaagccctcaggcagaggagcaaatacttgcaagaggacaccagtggcaagaacagggacatggtgagacttcgacatcattggctacagtagtactagtcactcttgactgtggtttatgttgtttcaataaagtagctttccttctcaaaaa

SEQ ID NO: 6430 - DNA, 2943 bp, Homo sapiens
cactctgcgccgaccggctgggcctggcacccgcgggcggccccagcctcagtctccagctacctttgcctcctgcggccgcccccaggcagagctgcgatcccaccgccgggggtgcagggagagggaagatctggcctccttggtccttttgcgtgggctcttcagagcgtgagcgccggggagggactccggagaaaagcttggggggctgcgtattgctgctccccaagctgggcgtcaggaccaaccccgccgcccccacgggcctgacgggagaggaggaagggctcgggacggtcggctcgccgagccaaccaggtggcgcctgaagagctgtccatggtgtcgacagcccagcaaacggcaccgagttcctagtctgagtgtctggataggtagcagaagaaaaactaatgcctgctctgggacagttctgttcggtgccttttcttgtgtgttctggagctcacagggttctatcgaagagtgcttaggtgtatacgatggagagtgggacgtcacaaaccaggatctcaaggctgagtccaacaaaacatggccgtagggaggccacgacagctgtggttgtcaccgacggatgaatagcttttgccaaccgtggaatttagtaactaaaggcacctaacccttttatctcatcctcatttttcaacaaatggtgcttcctggctaatatcagcgtgtcccatagatttctgcttccattgaatagacctaataagaaagagaatgaagtcaaagccaacagggcagaaagaaattgaaaacctgaagaacccagcactcaaactgtctccacttgcgtttgctttttctttacctcttctccttctggttttcaacagccaaagcaggatttaaatttggttatgttgcaaaaatcatttccctcttcaggccctgtcatgtgacttgattttttcgtccattttagagaagctgtacccaccctggtttcaggacacggaactaaatttattagaaaagaagccacttcaagtcatgaaggagaaacacaaagattcttggatttagttctaagaactagaggggatttctatgtcagtactgtctcagaaaaaactgttgatatcaaatgtgttgcttgagaagtacctttttttttttgagacggagtctcgctctgtccgcccaggctagagtgcagtggcgcgatctcggctcactgcaagctccgcctcccgggttcacgccgttctcctgcctcagcctcccgagtagctgggattacaggtgcccaccaccacgcccggctaatttttgtatttttagtagagacagggtttcaccgtgttagccaggatggtctcgatctcctgacctcgtgatccacccgcctcggcctcccaaagtgctgggataacaggcgtgagccatcgcgcccggccgagaggtaccttttatgacaactgaaatcattcagtttcaagaggagttgggtactgaaaccaaacttgcttactccaaagcccaaaatcctttccaccatgcctgtgtgtctgtaaggctacactagaaatgcttcctttcttatagtgggaagcatgggtactaagctcttttacgaacaagtgttctgcatattcctggttcctttttattttggactgaggagatttaggtcaaaatttctgggttctgggttggaattccagcttctttcttcaaattaaactggggggtagcaagacttattcctagatttgttagaaggccacagcttttccacatctcattttagtcatgaaaaagacacatgcccagagtttgaaaaacataaaggcaatttgactagtggcttgattggttctatcttctttttcttgtccctctttcctatttatacttctacttttgttacagcatttgacaatagttggaaaaattttcactgaccttgaaatgtctttgggatagggtgacttaaaatataggttaagtggcatacacaaacttcttagtgagatcctaagggcctacagagacaggctgacaccaactcaacccttgaaactgtgcaatgaagagcctgtgggaggctaaaaaacgctacttcaaaaagagatccttgtctgtgaatgttaatttaggtttacagatttgattaagggtcttgagattattttcaattatccaggtgggccctagagccctagatgcaatcataagtgtccttataacagggaggcagaggaaaattaaacacgcacacaggagagagagagagagaaaaaaaagtgatgtgaagacagcagcagagattggagcgatgtggccatagccaagctatgtcagcagccatcagaagttggaagaggcaaggaaggatttgagcctagagcctttggaaggagcatggccctgttggttctggcctccagaactgcaagaaaatacatttttgttgttttaaaccacccagttcatggtaatttgtaacaccagctacaagaaattaacacaaggctgatgtgactttccatcaggagagagacagccccaggtgagacctgcctgcctcattgtctgacagctttcccagcctcctccaggctcccctccgttttctcttatacgcattcccccaataaacttcctgtacatttaataccatctcagtgtctgctcccaggaggaccctaactgacacactggggcatttagcctccaattccttttctcccttggctgagatctgttccaggaagtatctccaggacactccagcctgttgcacaggccaaagaaaagccctcaggcagaggagcaaatacttgcaagaggacaccagtggcaagaacagggacatggtgagacttcgacatcattggctacagtagtactagtcactcttgactgtggtttatgttgtttcaataaagtagctttccttctcaa

SEQ ID NO: 6431 - DNA, 4942 bp, Homo sapiens
cggaaggggcggcggagcaccgatctcatggatgggctccgaggggcttgcgggaggggggcgccagtgttcggggccgttttggcggctatgcaggattggcaggagctgcgatgctcacacttgcctcgccgaccgccatttcacatccagcagaggaggcgggggcagccgctgagacggtttttcacaaggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcgtctgccgcttctgtggtttctgtcggctttctccatatttacgtgcttgtaactctggcatgacctttgctccagtctctaccagagggcggtgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccaatacagagcccaggccccacacccagggcctctgagtatttttgtttattgtatgtaaaatactagtgtatttttgtttaagtctcacaggtaaacaggttctctcatactttgccaagggaaatgtgatctgtgcaatttggcaataactatcagaattttaaaagcttatgccctttgacctagtaatttcacttctaagaatttcccctgcagagatatgtatatcttgtatgaaatgaagaggctacgaagacaggcaacgccgcagtgtttataatagcgaagaccagacacaacccacatgtctaaaggttctgatttttaaaactgtagtatatctgtacaatgagcactccacatcctttaagaatgaggaagggctgtgtgaactgaaatggaactatctctaagatttattaagttaaaaaaattcaagagtagcacagtgtgtagggtatgccatcatttgtatgatataaggtcgtatatctgccatctcaaatgaggaacagtggttgcctctgggaagggaattggatggctaggaatggggtaggaaagaggtttgcttttcagaacattttatactatttaagttttgtaacaagtgcatctattttgacttaaaagataaaaaatgaaaaggaaaggctccactagtgattctgatgctcacaaagattaagaaccaatgcgaatgaggaactcatgacaccgcccaggagacagtgaacatatctcttcaaatatcaaaaacctttcagcagagggtgagaacatgtgcctggggtaagcatgggtgggcatgagctgggtacagaggtgattcccagggacatacaactaccttgccctcctgggatcaggtcttcctcccaccttagcctcccatattgttgggaccacaggcatgcaccaccacacctggttaattttttttttttttttttttttgtagcgacagagtctcgccatgttgcctaggctggtctcgaactcctgggctcaggcaatccttctgcctcgtccttccaaagtgctgagattacaggcatgagccactgcacccagcctgacagtagcttttaatctctggactctcatcaccgtttggactgtgagctgtggttctagctcttggatctgatgggcatcttccctcaaatatgtcagtttctctctccaggtcccttgctttgtcttcctttttgcctcctcgggcctgatacctttctctgggcttctctactctgccccgagctgcctagttttgcgaataatgtcacatccagatgtcagcagccctgatgtccatgtgacaatgctcccttgctgtccatgtgacaatgctcccttggtgtcccagtgacagattttcccatgcttcaccctctctcttttttaatttttttttctgtacacagctctcagtcaagccccttgagctgcctccaactgtttgctcatgtctgttcccagcaatcttttcctcttttagcacaatcttccttaacttactagttttttgaaacagagcctattagtcttcacagcgctacctttctgatctcagagttcaccaaaaagcttttcctcccatcatgcctgcctccctttcttcaggtccgttagagtccaccgtggcctgtgtgggaagcaagtctctcccagggcacacatgaacagacttcatgcccacatccacagtgaacagtggcttctgccttccagatgggcttaccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaaactttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaa

SEQ ID NO: 6432 - DNA, 2541 bp, Homo sapiens
ctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtctttaatgccgcaaaggatgaggagagagccaaataacgcagagaagagtgtttggggtacagaaaacagtcagtgcaagggcactgcagtaggaggggcttgcacatttgaggaacaggttggtggtccctgtggccagagcaaattgagaagagtgccgaggaagagatgtgcttggaaagggtcagattcatgccactgggatgggaagaggtaagtggaggttcacaggaggtttcctgaagaaatcagctcctggaggaagtgagggaagaaaaaaaagggccagggagtgccatggcaaccaattctgagaggtgagaggtcatgggatgccggggagggtgatcagcagacaggcctggctggagtggaagggcgtgatctggaggtcccagccctgtcattgccttgggagaaagaaaacggccacaggtctaagggctccaaggcaaggctgatgggatagagctatggtgggtgaaatggggtgacagtgaggcaggggacacaagccgttccattgtctttctgtctctccacagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtct

SEQ ID NO: 6433 - DNA, 4483 bp, Homo sapiens
gttttctccccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatcccca

SEQ ID NO: 6434 - DNA, 5531 bp, Homo sapiens
cggggcgccgtccccaaccgccgacgcctgccagaccaccaagtgggggccatgtcgacgtgtgaggagcctggtggaaggtgatactggaattccggcactgggcctgcaacccttttagtccacagttgtcagaatctaaagggaagaaaaacgaagtgctcagaaccctcacagaagccgggcacctcatcccgtgtgtgggttttttccccagtacaaacccattgtggggacaggcgcttttgaagaaaaaattcagattcccgggctgaagtggctcctcacagccttgaacctgacccccagcttcccgctaaagccgagcgtgcccagcacggcgaggtcagcagaggcccctcggagggcggccgggggaggtcagtgggaggccctcgggcagccggtggatgggccggcgacctccccgactccatcagaagcgctcagtctgtgcccttcagttactggagcagctcccgtcctttggccagttctctggaaggtcgtttccgtttctgtgtctgccacacgtgcagcacaatcgaaaaaccttgttcgacatttctagaaagagtagatgctactgaagacccaatagattgctgagggttttcagagcagggacaattgcatcagggtgctgggctccgggaagaactcagaggacttggctgacgggcggatgggacagtgattggtgccgagaatgggccagagaagcaggtctgcctggagcaggcacccgaggccgcgtgcaggggcggtcctgggccaccaacccctggaagctgggccaggagcttcggagccatccgaggcttttttcgctcctctcactctcatgcacctagttaccctccccacagagtcttctcacggcgcggttttcggctaccattgcagtggtgtctgactacacccagtgcctctatcgttcccccctcagtctgttctcgcttcttggcaaacctgtccttggaaagccctctgctgactcctgttaccctgatcaaatgcatcctcctcaggaggctcgtgagccctttgcagggtggcccaagaggcatcacgccctgctctccagccactcttggggtcccctacagggccaggcgtcccacaccagcagcgggtgctggtcctgccacagtctgtgcgacacgtgaatgaaggctgtagacctgtggtctgcgggaggcaaattccaactccagctgtcaaacataaggggactggtaggctctccagggtggattgtctcacggcatccagaggcagggaccgaggcagggacctagccaggcctcgggaaggagctgcaaacccaggagctctggggtgtggcttcatctccctccctccctaccaccctacccccatctctccgtgttcttcagatgcctcattttcctgtcaggcacctggccagctctaggagctggaatcaggttggtgcctccttggtcagtgtccacccctagtgtcatccacagtgaccaacggaaggggtggccggtggtacaggacattggccatcttgggaaagatcacagagacaggaagggcctctccagctgagcagatgagaggttcttcagtggtctggacacatttgcccactcatggccgtccccctgccctgttgagagaaccgatgaggaaagggagccctgcatctgtcgccttccgactccgaccgcctgaggctgggctgccggcaagccgcggcagcatatgacagcacttgaaagaaagtccctggaaagaatgtggatcattgcagaactccctcaagaaagcgccagaggaggaccccattcagcaccccgcagaactcctcaaactcctgcgtccacactcccccagcgtggtggctgcttctatctccccaggcttagctggcctgggtcttgaaggcctctcctcctgctgtccccacgcagcatcctctctgccactgcacagctggatgcagtgaaggccaggcggctgtggctgcttgggcaacaggagctgcttgaccctgttctgctggccttgttggcctcactcccgtagagagccaaggttacccacgtctctgaagctaaggctttctttctaggcctgggggagtcacatcttgcattcgtactcactgagctccacgtctatggttagagaatttatcaacattttataatgcttttatcaattccatcatttgagggccctctggcaaggaacctgttagtacatggagtgcctggaatgttccagaaagctaacatgaacagctggcccttgctgtccttatacattgaggactccaaaggccactcaggatgacaggaaatgcaggctccaaaagattcggttcctttgtgaggccctcgggcagtggtcagacacgaaggaaataggaaatcacccccaaaccacacctctccctatgaggccacagctgccgatgcagccttgggagggggatggagggagagaggagggcatctgaatgtggacacaccctgctgtgagggctgtgggcggtcctgagactggagccagcccccaggctcagctcagctcggggacctcgtgcccgggctttcctggggaggaaggtgttggatctcctgcctctctgtattcattcacactttgggtttctctctcttccgcgcattctaacatctgcaggatttttttttttttttttttttttttgagacagagtctcgctctgttgcccaggctggagtggagtggtgcgatctcagctcgctgcaagctccgcctcctgggttcacgccattctcgtgcctcagcctccagagtaactgggaccacaggcgcccgccacgacgcccagctaattttttgtatttttagtagagacggggtttcaccgtgttagccaggatggtctcgatctcctgaccttgtgatccgcccgcctcggcctcccaaagtgctgggattacaggcgtgagccaccgggcctggcacatctgcaggatttatggatgaagggccacaaacccacatttggtctcattcaacagatgttgtgtcggcagggcgaggtgggactctgtctctgcccacgctacctgcccctggggttgtagttctaggaaagcaagtctcagactgagttttgatctggattaaattctgtcccaggtgcagatatttataggaaagcagggacaagagccctcaggcaaagctgggtatcctgcgatgggtgcctctgggagttcgcagataacaaggccttttcctggaggcaaagcagaagcgttctgtggcagaccagtcagctttctagcaggtcaggggcagggacatctaggcccaaggtgtcacaccgtgcctggctgctggctctcctcttgcaaggacacagctcttacaggacttcctagcccacccaagaacatctttccatcatcgaaaagttattgataagatttttccatcactgaaaagttattgataagtgccaccatgtgcatgagcagccctccaggtgctggcttgtgggccggtgtttgagaatcttgccagttgaatgtgggcatctgttgagggtttcccaaaggctaaccgttcgtgccagagggaggccgtggctcattcctagggccctgggtgagactggggctcatgcacacacaggtatcgatggcatgggctgtaacgagctgagtgcctgctgccctttcctagtggggggggtgggctcctggagaaagaggggaggctgctactctccagggccacagggagcccagaacgccacctcctggtgtcagcagcagcaaatccatataagtctgcagcaacttagcttttgcctcctcagaggaaataattcatccagggggcacaaggcagggtcagagactgaggtaagtttcagagcaagagtgaaagtttattaaaaaagtgttagagcaggaacgaaaggaaataaagtacacttggaggagggccaggtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtgcttactggagttgtgcggtgccctcttgaggcagtcttcccttaccagttcctaggggaaggtcacacgctggttaaactttgccactttgcctcgtagtgtgcatgcttgacctcactcaccaactcctgagattttttttaaattttttaatttaagttctagggtacatgtacacaacgtgcaggtttgttacataggtatgcatgtgccatgttggtttgctgcatccattaactcgtcatttacattaggtatttctcctaatgctatccttcccaccccacgacaggccctggtgtgtgatgttgcccgcactgtgtccaagtgttctcattgttcaattcccacctgtgccaactcctgggatcttatcgggaagtggctcatcatcagctttaggtgttttctatctattgggagcctgcctttctctggcaccagctgcaaccaataattattttagacagtttaacaacagcttgaccatcacctgatgatcacctgacatttctgttggggcgcgggcccatctcctgccccgctcatgtggggctcagtctgcccaacctttccccaagggcctgtctttacttcatttgtggtaagccccaagcagaatggactcttgttatgatcccaggaactgctcacggccacctctgtggatgaacacctagcggctgctctaaatacatgctgtgaaagttgtcagaatcaaaatggagtcactaatgttaagaaagccctgacaaagagttggtggggaaggccacgaagagaggacacttatgcttgcatgcctgataccagaaaggactacaaaaaccacagcccggcacagaggccatcacacccttacacaaaaaatatttctgcaaggacaactgcccagcaattgcctgtccaacctcagactggaatgacctttgttattgatgtttgtagccaaggagaattatctcaaaaccactgtgatcctgctcgcttttcctttaaagacctttgtcttccttgacctccctgaataggcatatggtttactatggcgtgtgtactctccttgtaatgttctgttctcaagctaacatctattcttctagagaacctctctcttaggctgacaacgctgtggatctgggctcccaggaactggggctgacatcagaggggtggaaagagaacagcagctctccctgaggggatgcttgccaaggataaggagacgatggttctctaaggattattttatattcatctaaaagggtatttttgttgttacccctagccttttttcccttttaattttctgatgaataatttatataaagaaaacccattctaagtgtgcaattctatgagttttgacaaatgtct

SEQ ID NO: 6435 - DNA, 568 bp, Homo sapiens
cggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggtacagggggagtcctagttgtcttggatttcctcaattcctattctctctttcatcaggtcccagtactccctatgccacttccatttctggcaatgctagttttctctcattgagatcctcatatttctcctgacttcttctgttccccagtatctgattccaatctgtcctcaggaacctctcaagagcttaaggcctcgaaaggtcaacaccccggctggtagctctcagaaggcgcgagaagagaaggcactactgccattagaactacaa

SEQ ID NO: 6436 - DNA, 822 bp, Homo sapiens
ctgggaaactaagtcacgtgagaacctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtcctgcaaccctggttccagtctggcaagcattgtagacctggctgctgaagactgacggggcccagggtccgctgcccccaccgccatcaccacctcggaacccagggtaacgctgtcagtctttgagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgcca

SEQ ID NO: 6437 - DNA, 925 bp, Homo sapiens
gactggcgggactgcgcggaggcgactgcagacgtatcgggggtccggagcctgtcgcggctgctaagcgctcggcgcctggcgctggcgctggccaaggcttggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagctagaaaattatggcatgccgtttagcagaactgaagatgggaagatttatcagcgtgcatttggtggacagagcctcaagtttggaaagggcaggcaggcccatcggtgctgctgtgtggctgatcggaccggccactcaatattgcacacctcatatgggaggtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactattttgccatggtctccatgaactgatttttttgtgcagtgggcaggaagaacccatcgggcagctacacatcttgaaagagaagctcttcctgtgaggatctggagtattacggaccacgagagatgcagaaatggagcac

SEQ ID NO: 6438 - DNA, 2283 bp, Homo sapiens
ttcctgtgaagggggaagctgctgatggagacttgtatctgcagtacttcaggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtagtccagctgttctggggcctgtgtttgtgcacctgtggtgctgtatcctgccccacagagctggctgtccagtggagaatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgagaaatggttaggattgttctgttggataagtgcagacacctgcccagggaagcagctctttttttgtaagagttttcttggttactgaaatcaaatgggggaccagtttgttataggagacatctgtggccagcaaatctgaacagcttcctagagggaaagtacctcttttaaactaagttattatagacagtgaatgaatcctacccttaaaagagatgacggcagggtaagtgcaaagtaaaacctccttgctctagtctcttgggagagtattgtaatgaaagcagcgtttacttcgttgttgttgcattggggtgaaaaatctgagatgctggaatgatggcaatgtttgccttctctccttcccttcctgacagccagtgtgggccaggctccactctccatcttcacaccctgcccttgctccagtatttccattctgtttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgcttccttcccatgtgcttctccccaaattttcatatagatatatacgtacactccttttggaataaacgaagaggtacattatatttgacacaaacttgggagtgttaagaggtcataagtgtttacctatcagataaccatctgtggctctgtgttggattttttttataccattaggaaaatgggaatttttttataggcctgccatacttctactttgccaaatagcactttattatcaagatacacccatggctcatttcagactcactgaactttttttatatgaatgcacagtcgtcatattttgggcagtctgtgagttcttggtaactcatccccttactacaaaagcactaagtgaacaatacaaaagtataaaagcacaaatttgaacttacatagtttagtttaagtatgtttcactagaaaatcaaatatttagatttctcacattgaaaatgcttaggattgaggtttagctgcttcctttaaaaaaaaaaaa

SEQ ID NO: 6439 - DNA, 1378 bp, Homo sapiens
taatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatggtgagaaacatttcccccacccaacaaaatatccccaatccctgacccctttagcccttacccctcttctgagaaactgaactcaatcccactccttgattcaaccatgtttatctttgtcccttagatgattaaaacccaaagttccttggtcccagctttgacagattttgttcggtgagaactttgagatggatggggtgagggtgtgtactgtgtgggtgtgacttgctgggcagtctagggcttgcgtgtaagggagtgggttcttttgggtaaatctttgagtgatccccttcccccacccacctattttgtagttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatccc

SEQ ID NO: 6440 - DNA, 499 bp, Homo sapiens
atcaaatcctttttgtctcttctcatttcactaacagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagca

SEQ ID NO: 6441 - DNA, 3805 bp, Homo sapiens
tcgcgagactttcaggggtcggagcgcgggggccggccgagaggaaagctggaggcgcgggtggggaacatgtctgagtcggagctcggcaggaagtgggaccggtgtctggcggatgcggtcgtgaagatagaatcctggtaattgatgtccacccgagaaatccctgcagatgttccagcctctgtctagtccagatagccacaggaagggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaagaggaagtccattgcatggcctttgtttcttcacctttggtctctgagcatgaggaggactgtgtgtgaactgccagcagctgtagccacctgctcacagcctctctgagaaccccctgaaaccagttgttgggtatccttcccatttgccccctcaggcgtagttttcagaactgcttccacctcgtaatcagaagttgaagattgctgctgcgtggcctgatggagatgactgatgtcttaaggcgcctttccttctgtggcacctcttcgtgtgttctcacctggggacctggcagggcacatctccgctgtgcctactgcaaggcggtcccactgctgctgtattagcaggggaagaatcctggctgtgtggatggcccactccattgaagtcaagtcctgcagcttcatagagcttgagacagtccaagcttcagctctggagggcggaggaaagctcatggcatacccacctggccggaggagcccgattggggttaattttatcttcacgtagcagctgaagtttgaggacaaaagggccacttctgatgcccctctgagtttgttcctgtggtttcacttgaaccagggatgctagatgcaaaagtcatattttagcaatttcttcagacgatatacagaaccccagcgctcagccgttcttatttctttttccttatcgtagaattaagatagggagagcccgatcccacttgcccctgtatcctgtaaatgttgatttatcatctactgtaagcgaggcactgttgtaagcagcagagataaatggataaatagacacaggcttctgccttcaaggagcttagagtctgatggaaagacagacgtgcaaacacaactctgaaagaagtgttttaatggagaagagaggtgtaggcaaagtacactgagaacaaaggagaaggagcaactatgtctccctaggatggccccacaggcgacggaatgcctgcgctgggacccgaagttgactgggaatcccagacagaaggagggtagcctctgtgtttgctcaggatcatgtaatgcatattatagctgggaaatcgcaagtagttcagcatagccagggtgtgtaggggcaggggaaaggcatggagggggaggctgggcaatagggtacaactcatgtctgactccagttctggaacattgattagaccttagttcttgcaagtgctatagtgagtacattcagggtagcaaataccctccctcagcctccccactcccttttccagaaaggtctgctaggctctgccctgcaaactgtccaggctcctctgccctctgggcttgttttcctctttattgctacttggctgtttttcacttggtcctcttcattctatgattaaggcaacccatataattgaaagaaaaataatgtgcagcctgtttcatcccttccacttgttttcttactatttatttatttatttctgagatggaattttgctcttgttgcccaggctggagtgcaatggtggcgatctcggcctgctgcaacctccgcttcctgggttcaagcgcttctcctgcctcagcctcccgagtagctgggattacaggcatgcgccatcacacctggctaattttgtatttttagtagagacggtgtttctccttggtcatgctggtctccaactcccgacctcaggtgatcctcccgcctcggcctcccaaagtgctgggattacaggcgtgagccaccgcacccagcctcctatttgctttaaaagtaatttcctggccggatgcggtggctcacacctgtaatcccagcactttgggaggccaaggcaggtggatcatgaggtcaagagatcaagaccatcctggccaacattgtaaaaccctgtctctactaaaaatataaaaatcagctgggcatggtggcgcacacctgtagtcccagctactcaggaggttgaggcaggagaatcatttgaacccgggaggcagaggttgcggtgagctgagatcgcgccactgcactccagcccggcgacagagcgagaatctgtctcaaaaaaaaaaaaaaaaaaaaagcattttccttccccaatttttctgtcattttcccatcctcattcaggcagagagaagaataacatgcccccttccaaaaaagacaaaacacaaggtagccacaaattccctagacacattagaaaaatagggagtggagaggggcattggaatgaaagttctctatctcattagctgttaggctttaggcatttatttggatggatccctttggcaccttggaagcaccactgaagtgctctgagaaaggggtcagctgtctgagggaatagttctggatagaggccacaggaagcactggccagttgctttagttctagatagctttgtattcccgccttgttgcccttagcggaggctggcccaaagcacacttgatcttgtccccactccctgcccccatctcagatcaaccttcagaaagtcccggcttgttggcaaaggcacacattctgtgttactcttaagtttcattagaaattcaagtcctctggggccctgttcccttgtgggcttgtgcaactgactttgtttcttgtctgcctttctggaaccaaatccaaggaaattcatgggtttggggagacagcgatgggaacccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagattgcagatgccgtcttgaagtcctgcttgtaagaaatgcaggggttgggaatggaggagatgacgatgtagttttgcttttagttttcccaaacctgtttacattttttaaaaatgtaaccaacccataattgcattttacttgtcgtggttcgatctgattgtattgtcgaaggactatttttgaacctgtccaaataaactctgcaaagtatttccacaag

SEQ ID NO: 6442 - DNA, 901 bp, Homo sapiens
atgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacagcatcacgaaccacgagtccagaagcctaatccataatcctccctc

SEQ ID NO: 6443 - DNA, 3476 bp, Homo sapiens
ctgcagcggctgcgcgtgcgcccagaggcgcagcgggagggggtgctctcgggcgagctctccggccgcggcccccgcccctgcgctgtcgggcggggaggtcggaaaccccctggcgagaccacgggcggacgcttcccgaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacagtcgtccttgtctactccactaccaaatgttgaagttcttcaagaatcagtcctttggaggtgatgtcattgaaaatgatgagtaggaaactccaagagcgcatttctccacaaaaccagtgaatacattggcacaaattgtcagaatcaattttatataaattctggaaattagtcaaaggtttatagtaaccaaggaaacatctttttaaaaagatggctgaggctggatgctgtggcttatacctgtaatcccagcactttgagaggccaaggcgagcagagcatttgagtcaggagttagagaccagcaaaaaaattagctgggtgtgtttgcgggcacctgtaatccctcagggaggctgaggcaggagaatcgcttgaacctggaagatggaggttgcagtgagccaagatcgtgccacctcactccagcctgggtgatagagtgagactctgtctcaaaaaaaaaaaaaaaaaaaagtctgaatcctgaatctcaggagcgctttctatcatttaaacttaccctggtgccacctccctgtccagctttgaaaacaacgacatgcatttctgatatctgttcctggtgccaaagggagcaggatggccttgttttcttttcttctttcttttttttttttgagatggagttttgcccgtgttgcccaggctggagtgcagtggcgcaatctcggctcacagcaacctccgcctcccggcttcaagcgattctcctgcctcaacctcccgagtagctgggattacaggcacttgccaccatgcctgaccaatttttgtatttttagttgagacgggattttgccatgttggctaggctggtctcgaactcctgacctcaggtgatccgcccacctcagcctcccaaagtgctgggattacaggcatgagccactgtgcctggccgtggaccttcttttcaaagaattatggaggcttattttagttcccctaacttggaaatctcctgaggaagaaaggtgactacaggcatttgtcaaaaatttgtaaaggcaagtttattagcctctgccatcgggggcaaagaataatagctaaggcaaacaatagacacaccaaaaagcctgggaggaaaagctggaaagtaagatattttggagaataaaggcttttaaaacttccacatattcttgggaatccaaaaggccacatgtacatgcagggtgagcaaatagagaagacttgagaaagccttaaactctcacctctggctaaccatcaggcttgctcaaataggaagtgaaaactaaggtgaatttgttgcttagctgaatgttgaaggtgtgccccaacacttacacagagcctactggtaaagactgagagtgttttctttttgtcttggtttcaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcct

SEQ ID NO: 6444 - DNA, 803 bp, Homo sapiens
gatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatatttttatggctgctcttttatgttacccactgt

SEQ ID NO: 6445 - DNA, 557 bp, Homo sapiens
tccttgtccccttcattcttcttttctcactgtgctttgatactctctttctgctttttcccttttctgtctccttcccttgccatattctcatattctgtttctgttcctcttactacccctatcctctgctttctttctggtctgcctctaccctttctgaatagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaag

SEQ ID NO: 6446 - DNA, 1475 bp, Homo sapiens
actttctgtagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaaggtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattg

SEQ ID NO: 6447 - DNA, 4222 bp, Homo sapiens
ttaaatatgtccagaaggaatgatcatgtatctaatagactacatagttggttcccttggggagttatatatcatacagttactaaatatttgtctaaattcattttttccaaaaacctgctctcaaatttttcttctactctcagttcataaataatataaccattgaaacaacacatcagcctctagctgatcctctgaaagtagccattgaaataatcgaatactgtgtgaacaggaaaggaaagcgttacctttaagagaagctttaaaataggaatttattgatatttcacaagatataggtttacagaagacattattcaaataaatatgtacactatttgcctgatgctatggggtacataattttttaaaaactcccttagaccagcagccattagtgtagaaatgatggactttaaaggtgataccatgtaagcagatgttgcatataaaaatattcctgcctgaatctgatcgagattcttgaatgggggaggagtggcagccggcagcacattgcaaatgtcattcgaggtcacggtgaggctctcggtcccggaacagtgggggcctcgccaggcgttgccagtatccctttcctcctgtaaaatcatagctttgtgttacacgactgcttatccagtcttagggtttagcagctgaaaggtttacaaaactgaatctggttgaatctctgtgaaagggtcaacacatctgtcggcattttgcacacttatgtattattatgatacaacatattactttatggtaatttttatttttacatataactacctccataaatttgatgaaatggcagccgtgtgttaaagtgtatcgttcagaagagcaaagttgaacacttccttcaacattagggcatggcgtgctgtgtgtgtcagtgattgcctctgtggactcatgactttccatcgccatggctttctcttacgccgctgtttggctttcagatgtaatcctgtcttctcctctcttccccacgaaagcgcactcgattttgttaggaatgaacggaagtttaaaaattcttgtgcccacccccgccctccacccattcctgttaaaagttctctggcgaagagccaatgggtgaacgtaattgaaagagctatttactcttttggaaatctgatttgaagtctaagttttcagtaacagaagacacacaagcaatgtggactgccaagcttgaagcacttcgggctctgccttcactcgcatgctaccatgtcgagcccaaactccactttaattaaaagagctgtgctgtgaattccacaacttctgttaaataatttgtattccattatatatattttgcacatctcaggggaccataatgaacatatgaaaggggggggggtgccatcaaatagagaaaacaaatagaagaggtgaatggagactagctggataaaaataacaaattacttcttctctgatgttgtgaaggtcaggttcaggaagcatcaattcacagttaatccggagtaacaatgatctgaacaccagctgttcccaggtccctctttttcatagcccaaccagcatctaaaatgtaaatttaaattacattgcagtcaccatggggagaagaaacctgttcagtggaagcagaagcattgttccttttttaggttggcgcagctttgcaaaactctacccaggataaaccacttatcaccaccaagtgtacttgaaaataaagtttttaacttaaattacaagcatattgctcataatacaatagtgatcattttttgaaagtcttgccatttataacatgggcagtatttggagcttcatttaaaaaccaacaacaaccgataatgactttgcacgattcactttgggatctcaaagtgcttccaaagcattcagatttacaaacaattcacaagacaggtcatctttgtaatacgcatacttacaacgaattaacaaaaggagtgacttaagattctccaggaacacagtggcagctattgatgatctgttttctatctgtttgatagagcatcatgagaaatcacaaaatacaatgctatttttctgatgtgtgctaataaagtcaaagaaaacaaatacatcttgacacttttgtccattttcattaaaaaaaaaaaagttcagggtgtttggaattttacatctcagcacaccttactggtatcaatggataaagcgggtgattgacagatccacccaaatgccactgcagtcagaagcagatctggacacacccttgtttacagtttcatattgggttgctatagttcccgtgctaaatcaccagctttcaggaacatgactgctcctggcagtggaaggtgctgaaacagaaattttaattaaaaactttatcaagtactcttcacagtgctgcttggcaccatagaaaatcagtacaatatatcgagccctactttggaggagctggatttctgagggagctgatccagttctaagtgtcttctcgaattaggagatagatgatctttgatggggatctcctccgtcaccacaggccagtcacagaaccaactagccacgtgctgccagacctcagtgggcccaagcaggagcaatctcttctatcccccatctcccccaggaccatcccgcccattgtcaacgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctctgagtgactgaatgtgactattgcattagggtaaatgaattaagacgtgcaagtgggatttactgtatgttagaaaggagttttgcagccaagactgccttgaataaaatgtgtttgcactgaaaaaaaattttaaattacttggtctctggttgctgtaaaggtcatccaagatggatgttctgtttatattgtatagtatttcatatgaaataattacagttcatgaaatgtcttccctaatgttactgatttataacagcacatttgtaacatggtttttatcgtgtcagtgtaccatactgtaaatgatgattacttgtcatgcttagtataataacttaaaagaaaaaaaaggacagggatttttgtaagtctatatttgaaagtccctccctatggtgatactgtgttcatgttgtttatgtagtgttgtgtgaaatatccattttggattgtgttactttttaagatattaaataacatttggtta

SEQ ID NO: 6448 - DNA, 1053 bp, Homo sapiens
agaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagaaacacccttgaactggctccagagggactgaggagagggtgcaggatgtgacccagagcccaaggacagacactgccactcactgcagtcaggaagagcaaaaggcttcacctgccttctcacaggtgcatctcatgtggggagtatgcaccgctctcccagttttaaagatggagcacggggctcagagacatcatatggcctgtctgtaggtcacactgctgagaaggaagagctgcagttgaacctgggaagactgattccacattgtcagccatggtgatgccttgccatggtctcaggagctgctgagcagttgatgcacttctgggcagtaactgatacaattctcacaccagtccagtggtgggtatccagaaaaagaggtcagtgttcctcattacaggtgaggacactgagggctagagaggtgaaacaacttgccaaagtcatgttttgagttcctagaaggcccaggactcacacaggtcaccgaggaagaaaaacaatatctgaatcttgtggttagaaagattagagagaggccgggcgctgtggctcccacctggaatcccagcactttgggaggcctcaggcggatcacctgaggtcaggtgttccagaccagcctgtccaatatgatgaaaaccccgtctttactaaaaatataaaaattagctgggcatggtggcatgcgcctataatcccagctacatgggaggctgagacagga

SEQ ID NO: 6449 - DNA, 2364 bp, Homo sapiens
acaggaaagggccctgacaagaggatgggactgcagttgtggctgccaggtctcactctcccttggatggtcggcggggtgggggtggaggccagggctgtagtgcagctcccgcaggtgctggctcagggggagcaggcaggctccggttttcggtaatcctcctggatggggatggtgctgccctcctcctccctggggcagctgtaatgacaaggctctgcaggctccacaggactttctcctttgtctgcagaaggagatccgatgagtcttggccagcagtgggggcagggggagacgggagaaggagatgggtagaggcgggtgcgcttgggggaggggtgtcaggagcacgccagctaaggggagagaaggggtaggaccaaggctggtgaagtggagctggtgggtttcagtgagattccaggcgtgggcagtggggttgagccagtggggtgtggtgcaggggcaggaccggaggcctgtgttctgtctcttacttgatctatatttccttcgttgatggaggaacagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatttgggtgtgattcagagagctgtttatgcaaaaccagctttgtcaccatcaggcaaggcacctgaattcccaccgcagagagtgttgtggccgtgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgattgataaacagacatgtttaatgatagcttgcttttcacagaggtgacttcggagacttctaatctataatccaggagtatataaccatgcagcacagaccaattagtcacatgtaaaataaactagattcttaccac

SEQ ID NO: 6450 - DNA, 1552 bp, Homo sapiens
cgcaatcaacacagtggaggcgagaagtctggccttgcgccggccggggagcttttcgccaaggctcctgtgggatgggatagcttgttctctgggctgcaggaaccaaaacattagaccaccctttctgtgaccttgggcatgccgccctcggttccgagccgcaagtctttctttcggggaaaatgaaaaggggtcaagatttggaccagatgacacccaatgtcccattcaacggtcgcattctgtcatccacaggaattagtcctgtatccgaaacattctctggtagtcaaaagctgagcctggagacagatggaggggaagacagaagagagattaaggagaagaatggtttcatttggaaggacactgactaaggaaaaacagagaaaaggatgaaacccaagccaactctgcaactctattaaaaacaccaagacttcaatatgaacctggcatggtgggcacagtcgggcactgcaggcggcttgcctccagcagaaggaatactgctactcagctctagatgattgccctgaagaaattcatgcccactgaatctccttaaagggaggcagtgcattcttcatggctagagcttcagcagctatctagaaccatatggtggaagccacttactgagaactgtgaaacaagagcctgggtccctgacatatgaagccaccatacctaccttaaagtgtctttcacttgagggaaaaatacatctttcttagagatttgaattttaatgtcccagaaatataaagaagatggcattaaaatgtcctatatgttggcagtcctaccctgaagactttttttgcttatcttttgttctgagctacagtcttcgcagagactaaattagtgactggacaacagaagaaaatagaccatcctggctaaaatggtgaaaccccatctctactaaaaacacaaaaaattagctgggcatgttagcgggtgcctgtagtcccagctactcgggaggctgaggcaagaaaatggcgtgaacctgggaggcggagcttgcagtgagctgagatcgcgccactgcactccagcatgggggatagagcgagactccgtctcaaaaaaaaaaaaaaaaaaaaaaaaaagaaaatagaaacgggaaatattcatgtcagctgttaaaaaccagttttgtaaagcaaggcctaaaagtcctatctctggcatgtttagtatggaacgtatagttgattgtcattcagctactagagaaaggtattctacaatggcagatagccttatcaaaacaattagccggctttctccacagggaatagcagtggggtaagtaagactgaagtgagagctcttatcagttttctcagaaatgatttctccatcataggtatttggccaactggttaggtctagcatgaacatgtgatttctaaaacaatgagctgagatctgctaacatgttgtaaaggagcatctagtagaagctgatctctaagcaaaatcaccaatttatttaagtttcaaaaattttttttccataaatatgttctttaac

SEQ ID NO: 6451 - DNA, 341 bp, Homo sapiens
aggattttggatttggactgcagatcacatctcttttacagtttgaatccattcagaattaatggtccagttgtcaagaaaacatttctatttcaatttcagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtg

SEQ ID NO: 6452 - DNA, 656 bp, Homo sapiens
atagtcgccaggcttggcggctctttctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaactt

SEQ ID NO: 6453 - DNA, 3129 bp, Homo sapiens
tttccacagggcgcagtgctttcattggcattggcttcacagatcggggagatgccttcgactttaatgtctccttgcaggatcacttcaagtgagtgaagcttgtccttagttacgaggctgaatgcttataggaatgctgcttctcacatgaatgggcagtatctcttttcctcctggtttctttgtttcttaaactatttcattgtgaatataaatctccccattcacttttgtttccttaggtcatctttgtatctattctgtttcctttccttatagcctgcaatatatttcagatcccttgtgcagtagtttgaaatgatgctctgtcgaatttgccccgtcttttaggtggtagagggaggcctatggtaacagcagggctttatgtggggagtcgtgtgccactcttgttaccttatgtagctgacatgttttgtgacttttgcaacatttctttagcccacttgattttggtgcagctgtggttgacagcactgtgcacactgtcagcttcctacctcaagagcaagcatatctctccttttctgccttaggactctctgaagttatagaaagctaagagcaagctttaacttggaaagactaagaaactaacaccccctcaggagcagccctcaactgtggggaatgggaattggtggctaaataccatccttctggaaggggcaattctaatacgtattccgtgagatttctcagagagtccccagtggaattgaaccccagttgttttctttcttggcttttttcccttctgtttctcactcttttttatctctcactgtgttttctggaatctcatttcataaaagtaaatacacccaaatttgtatgtcagactctgctttcaggaaatctcaaactaagataacttgctgtgttcccaaaggtgggtaaagcaggaatctgagatttccaaggaatctcaagaaatggatgctcgtcctaagttggatctgggcttcaaggaaggacaaaccatcaagttgtgtatcggggtgagtatggtttttaaaaattttgttttcctgtgcttccataagcctatgacatctttctcttgctcttctttttttcttttgtagaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 6454 - DNA, 732 bp, Homo sapiens
atatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaaggtaagttatttcttgccgtacgcaatttaaattgttagcacagacccctagaaatttttctgttaaatttctgtgtttttactgaaaatttgcagtttttcagtaatgaatgtgcatgtttcaaaagaataggtttttttgttgttgtttttttgttttttttttggaaacagagttttgctctttcacccaggctggagtgcagtgtcgcgatctccactcactgcaacctctacctcccggttcaagtgattctcctgcctcagcctccaaaatagctaagatgacaggcttgtgccaccacacccagctaattttttgtacttttagtagagacagggtttcaccatgttg

SEQ ID NO: 6455 - DNA, 2532 bp, Homo sapiens
gtagaactttattcagcttcacccttatttcatttttccatatatttaagtgatcctttctataccttttaaggtaagcaatcatctcaagattatcagacatctaaagaaaactttggtaaactggactatagtaatcgtatgagaaaaaaatagctcaagattcctaactgctacaagaatagtgttgatgggatcaaactcctaattatcctaatagacctaattcatttttaaatgtggaaaatatgcaagataaattaaatgcttagttaaaaaaaaaaaaaagtttcaccaactgttctccattactgagaagcccccacactgccccactgtgcatattcctagtatttcatccatgtcctgctctgctgtgctgccctacaaaaaaaccctcccgggggggaaaaaaaaacaaaaaaacggtgtagtgtgaactgctgaagaacttaaatgttcaagacatctttaaagtctaggagtacctgaaaactgtgggtaaacatggaccattttccttgcgtatcaacttcacactaagcatctaacattcaaacaaaaaagtgcaaaatttgtaattatttttaacagcaagaattcccaacctcctgccatccactgatgttccatcctgtttgaggttctacattaaaacatgattacttttgccataaaagaaaatattacccttaaaatatctatttgatatgtacaaaccacatttttattctgacaggtcacagattttgagcaagtgcttccctaggtgaccctacctagccaatatgaaggtggagcaaacactgctttagcttaactgcactaatatttacaccatgtaacccttctaaccaaatagaatactgctgacctgtcatcatcagtttgtgtgacatggctcaaatgtacaaaaataaacatagggagaaattaacccaatagatttcaaattaagtgataaaagcaaggcaattcaaatattaacatggcataaaacttccctactttagtggtttccaaatgctatttataaacaagggatgagttcacttgcttagatatttgaaatacaactttattctgattctaaacgaaaaggaatgggaatgacagtaacaaacaagatttcaccactgaatattgtgatgtgactgcagcagtcttatatatgaaactcaaggaatcaactgcgttccaaaacagctaaatatgcaggtccaaacaatgaagttattttttaaactgccacattcactccgaagcccactcatctccttcagcatcccacagatgaagcacatgttccgcttagctagataataatgaggtggcacacacgctgcaccgctgacatcacaggacagctgcctataaaactagacttctgacgctgggctccagcttcattctcacaggtcatcatcctcatccgggagagcagttgtctgagcaacctagacgaagagatggaaaaacgttaacactccagatcaaaactgccaggaataaacaagccaaaccgaacaatctgaacagcaaagtggccacaatacctctaagtcgtgctcatactgtgctgccaaagctgggtccatgacaacttctggtggggcgagagcaggcatggcaacaaattccaagttagggtctccaatgagcttcctagcaagccagaggaagggcttttcaaagttgtagttacttttggcagaaatgtcgtagtactgtttaaaagaaaggtaaaattactttttaaaattcattattaagatgacgatttttctaggacattgcaagataagaaaatgttaagattcttggcaaggcatggtggctcatgcctgtaatcccagcactttcgggggctgaggtgggattgcctgaggccaatagtacacgatcaggcctgggcaacagagcaagaccccaactccacaaaaaaacaaattaggtgggcatggtggtgagtgcctgtgagcccagctactcagaaggctgaggtgggaggattgcttgagcccaggagttcagggctacagtgagctatgttcatgccactgcactcctgcctgggcaacagagcaagaccctgtctcgaacaacaaatatataaatacacaaacatttcagctgaccaaccgggccaacagtgaaacccaatctctatcattctttaaaaacagtagtataaaaaagacaaaattatttccggccgggcacagtggctcatgcctgtaatcccagccctttaggaggccaaggcaagtggatcacttgaggtcaggagttggagatcagcctgaccaacatggtggaaaccccgtctctactagaaaaaaaagtacaaaaattagccaggcgtggtggtacacacctgtaatccagctactaggggagctgagacaaaactgcttgaacccgggaggcggaggtcgcagtgagccaagattgcgacactgcactccagcatgggggacagaggaagactccgtcttggggaaaaaaaaatcatttccatatataatagac

SEQ ID NO: 6456 - DNA, 2239 bp, Homo sapiens
ctggcgggagggccgcagggagtgcgcatgcggccgagtgcgggactggggctcctggctgtgggtgtggtactgaggcttcagcgggtgccgcccgcctagagggagtggagcggtgagcacgtcaggggtggggggcgcaggtcaagctttcaccagtttttaattctttgatggggtaaatttgagcaattttctcgacttgtcgacattcgttattaactgagcaggaatcaggagaggaacccggtcctctccacacagcccagcagagagcctacgactagatttgcatctttacgtcctgcgcggaggctgctacacacatgcagaagtcatgctggtggcctggacattgaagggagagaagtggatttgggagacatttaggagatggcaccgaaagcgaaggaagctcctgctcctcctaaagccgaagccaaagcgaaggctttaaaggccaagaaggcagtgttgaaaggtgtccgcagccacacgcaaaaaagaggatccgcatgtcactcaccttcaggcggcccaagacactgtgactccggaggcagcccagatagcctcagaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaagagaagaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaagattttacgtttctagtaagtataatattagcttatttgactagaactcaagcagaataggaatttatgcttgttttatattcaataatgataattttgaagatatagttgttttattacaccaaaaatactatattaatcttatttaactaagttttatccaaatcatgttaacttaagaaacatttgatcagttcctatatttctaggagtttggtgaatatttatttataaatgcttatttttttccaagccaagttagaatagagcacttttagaggatttcataaatgaattttgcaatgctctctggagttaagaaaatatcacatatacataacatacattattagatacacaaacacaaatagagatttcatagctttcatcctgaaatttcagccatgaatcaggcataaatattctgatggttaatttcagacatctacttgatcggattgagagacacacatagtggtcaaacacgatttcagccatgaatcaggcataaatattctgatggttaattttagacatctacttgactggattaagagacacacatagctggtcaaacatgatttcagccatgaatcagccataaatattctgatggttaattttagacatctacttgagtggattaagagacacacatagctggtcaaacacaatttcagccatgaatcaggcataaatattttgacggttaattttagacatctacttgatcggattgagagacacacatagctggtcaaacacgatttcagccatgaatcaggcataaatattctgatggttaattttagacatctacttgagtggattgagagacacacatagctggtcaaacacaatttcagccatgaatcaggcataaatattctgacggttaattttagacatctacttgactggattgagagacacacatagctggtcaaacacgatttcagccatgaatcaggcataaatattctgacggttaactttaggcatctacttgattggattgagagacacacatagctggtcaaacacgatttcagccatgaatcaggcataaatattctgatggttaactttagacatctacttgactggattgagagacacacatagctggtcaaacacgatttcagccatgaatcaggcataaatattctgacggttaactttaggcatctacttgattggattgagagacacacatagctggtcaaacacgatttcagccatgaatcaggcataaatattctgatggt

SEQ ID NO: 6457 - DNA, 476 bp, Homo sapiens
cccttttctttttagatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactat

SEQ ID NO: 6458 - DNA, 500 bp, Homo sapiens
ggctctgtcctgcccaccagcactatgatgacgaggaagaagaggatgatgaagatgatgaggatagtgaagaggactcagaggatgatgaggatatgcaggacatggacgagatgaatgactacaatgagtcaccggatgatggagaggtcaatgaggtggacatggaaggcaacgaacaggatcaggaccagtggatgatctaggtagacaaggcagggtggcctcagggagattccaggccagcccaaactaccctgcatcccaacccccaacccctgcccacagaaccagctgatggccccagtgcctgaaagtgcccttgggcacctcctcagctgctgccaggatctggtctctttggcccctcccaggccatcagtctgcacttgaaatccccagggcctgaaacctactccaccttcctggccagtacctcaccccttgattgccaggtctggtctaagtttctttaataaagacaaaggagtgattttcca

SEQ ID NO: 6459 - DNA, 2575 bp, Homo sapiens
ctgacttggggccggccgcgggcaggcgggcatctggcggccgaggccgggacttcggggcccctcccgggcgagtcgcggggcggcggcgggaaggggcgccgcacggaggaagtgccctcttggccgcagccagagccgcgccgcaggtgccgcgatgtcgtcctggccggggcgcgaggatgcgagggctgggggcgcgtggtggccgcgggagccgctggatcaggaactgcagcgggcccgggagcagaagcggcggcggcacgacgcccagcagctgcagcagctcaagcgcctggagtccttctcctcgcccccgctttggtgtgggcgtcgcctcttttggggaagccaagagttattggcgcttgctcggcatttgtggaccgaacaggcaagttcaaccgagcacgctgcccccgcgctccacctctgagttccctgggccactgcgacatggagaaaccccgttcttttcatcctctgctacggagaagggacgaggacacgggtcctgcagtgttggtgtggcgaggcccggaagaagagagaatgggcggcggggactggccacggcgctgctagagaaagggtctcacctgtggccaggagcggtggctcacgcctgtaatcccagcactttgagaggccgcggtggacagatcacgaggtcagtagttcgagaccagcctgagcaacatgttgaaaccccgtctctactaaaaacaaaaaaaattatccgggcgtgatagtgcgcacctgtaatcccagctactcaagttatgaaaaacctcctcctgggcttatcaagaggttggcattgcaaatggtatggtcaccgaacaggctacaaagaatgccctttctttatcaaagacaaccaaaagttacaacagttcagagtaaggcacatgaggatttcatgtatgacatcatacgagacaataaacaacatgaaaagaatgtaagaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagtagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattccttagaagtgtctcccacagggtggcaggactgggagaatctctgaggcgtgtcttccaggccctcccacagcttgtgccctccacagtgtagacttgaacacttggcctcatgtgatccttccaccttggcctcccaaagcattgggattacaggcgagagccactggttggctaaaatatttatatttacctgacatgatttgttgatttgggggctagggagttcttaaaacaacaataaaaaatcttctgtggctgcagctcctatagacagactacaggggaaaaatcccagagcccctacaaatccatctccaaactcaaatgagaactgagctcaaaaagcccactagcaaaccagaagtgtgctagccacccacttaaactttctttttcagacatctctttcagatatacattttccattactatccagggagacaaaataagcccttaaacctcccttcactcagacatcgtatgatgaatgtcagacatcctactgatatggtttggatgtttgtccgctccaaatctcatgatgaaatgtaatccccagtgttggagatgaggcctggtgggaggtgtctggatgatgggggcagatccctcatgaatgggttagtgccatccccttggtgatgagtcagttcacaccagatctggttgtttaagtgtgagtggcacctctccctccctcttttgctctggctgttgctgtcaccatgtgatatgctggctcctcattgccttccaccgtgactgtaaacttcttgaggcctcaccggaaagatattccagcaccacacttctcgtactgtctgcagaaccttgagccaggcaggtgtcttttctttataaattacccaggctaaaatggcatcatgatttctcccactaatcttcagactgttaataggatgcactttactcctgtgactagattgtgttaccagtacaaggaaagggagaccacctgggtgttcctaaccaaatcatgagaaccctctggaactcgatttgtccctggctgttaaccaaagaggaggtcagagagtccaagcctgtgaaagattccacgcatcattactggttttagagttgaaggggccacatggtgagggatgcagcaa

SEQ ID NO: 6460 - DNA, 5587 bp, Homo sapiens
gggggtagcgggaagggaggcagaagggggacggccccctgctgccacgtcgccagcagaggttgtgtgtggagttcagaaaagactccaaaagctgaccaggacggcggaggagatcctggtgagggcgaggaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttacggcctttacatgaatacgtcttgatcagacattcagagattagtcttaggtttccacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatccatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtgagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctgcgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggaccgcccctgacgtcgcaggccactgttcttatccagtgggccaagtgattgattgctagtggtggggttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagtgacaacttgggacaaatcaagacccgtccacactgcacctcagggacctcacctcacgccccacataaatgtgcttattggggggccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctccgcttccacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgccgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcttctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatttccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaa

SEQ ID NO: 6461 - DNA, 1663 bp, Homo sapiens
gggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgagcgtcgattagcaaggtaaaagtaacagaaccatggctcagtttccaacaccttttggtgcagcctggatatctgggccataactgtagaggaaagagcgaagcatgatcagcagttccatagtttaaagccaatatctggattcattactgtgatcaagctagaaactttttttttcaatctgggttacctcaacctgttttagcacagatatggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttgtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgagccacattgccaaagagttcttcctttagtagatctggtccagggtcacaactaaacactaaattacaaaaggcacagtcatttgatgtggccaggtcccaccagtggcagagtgggctgttcctcagtcatcaagactgaaatacaggcaattattcaatagtcatgacaaaactatgagtggacacttaacagtccccaagcaagaactattcttatgcagtcaagtttaccacaggctcagctggcttcaatatgaatctttctgacattgatcaagatggaaaacttacagcagaggaatttatcctggcaatgcacctcattgatgtagctatgtctggccaaccactgccacctgtcctgcctccagaatacattccaccttcttttagagagttcgatctggcagtggtatatctgtcataagctcaacatctgtagatcagaggctaccagaggaaccagttttagaagatgaacaacaacaattagaaaagaaattacctgaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagagctgcaaaacgggaacttgaaaggcaacgacaacttgagtgggaacggaatcgaaggcaagaactactaaatcaaagaaacaaagaacaagaggacatagttgtactg

SEQ ID NO: 6462 - DNA, 504 bp, Homo sapiens
cgcgatctaggcttaatgcaacctcgtctcccgggttcaagcgattttcccgccccagtctcccgagtaactgtgactgcagctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactc

SEQ ID NO: 6463 - DNA, 778 bp, Homo sapiens
ggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatggtactttttttgctttgacttaagtacagtaaaattttaagatttgagtcaattcgcctttttgtcttaatagctataatttgaaaattattcattggttaattcctaagtacattcataaatgtttacctgtattaattagactgaatcattttaaagttaaaaattacatttttgcatttaattttttattctaataaaacaaaattcttctgtttcatttttcttactgaaataatagtaaaagacatatacttagaaagcatctgtttaggccgggcacagtgg

SEQ ID NO: 6464 - DNA, 829 bp, Homo sapiens
accgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggcacgtggactccctttaatccagtgactgtcaggtcgatcatatactacactgaaggctggttacgctcttatgtgcaatagaacctcaaacacatcgtaacacacctttggagaatccttacaagaacaccaagttaacagttatctctgaccacactacctcagcaaaaaaccaggaagaaaaaatattcttcaacccttttcagggacagaaagcatcatttcaaaagtccaagaagggaaggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtcccc

SEQ ID NO: 6465 - DNA, 1051 bp, Homo sapiens
cgctgacactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgaga

SEQ ID NO: 6466 - DNA, 463 bp, Homo sapiens
tggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcaagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaaggtcctgctgggggtggatgtggctcttgtaacgtcctgagccccactgaccttagagaggccggggcctgtgaggggcaagtggctagtggtgcccagggtctggagtatagagaaccttgtggcc

SEQ ID NO: 6467 - DNA, 3578 bp, Homo sapiens
cctgctctggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagca

SEQ ID NO: 6468 - DNA, 700 bp, Homo sapiens
acgtggcggctctcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctca

SEQ ID NO: 6469 - DNA, 1879 bp, Homo sapiens
ggtggagtttcactcttgtcgcccaggctggagtgcagtggcgtgatctcagctcactgcaacctccgcctcccaggttcaagcgattctcctgcctcagcctcccaagtagctgggattacaggcgctcaccaccacgtccggctactttttgtatttttagtagagacggggtttcaccacgttggccagactgttctcgaactcctgacctcaggtgatccacccgccttggcctcccaaagtgctgggattacaggtgtgagccaccacgcccagcaacaatggttttgaagagcagaaggagaaatgaggctgtctgatcttgccctctctccccacttcctccttccttccctgttcctggcactagattcactaggattaggggaacttgtagccaagaatatataaagaacttctataaatcaatagggaaaagaccaaaaaaagtcatagaaaagcaagccaatgatttgagtaggcaaattagagaagtggaaaccgaaatgtccaataaacaggtgaagagtcaagcttagcagctattagggaaatgcaagttaaaaccaactaccatccaggtgctgtggctcatgccacaaggttggttgagtgtaaattgaaacaatcattttggagagaaatttggcaatctcttgtaatattaaaagctctttgactcctagatatatatcctagagaagttccagcaaatgtgcacaaagacatataaaagatgcttactatttgttaatctggaagtaacacaggggtcattaataggggggtggacaaagaaagtgtatgtcactaatgaactagatctgtatgtaacagtattgtatcagtcaggtgtgccgcaataatgctgcatgacaaaacaccctaaaactgacttataacaacaggcatttaattttggctagtatgtctgcatcagctggcctgtattagtctgttttcacactggtgataaagacacacctgaaactggggggaaaaaaaaagatttaattggtcttacagttccacaaggttgaggaggtctcagaatcatggcaggaggcaaaaggcacttcttacatggcagcggcaagagaaaaatgaagaagcaaaagcagaaatccctgataaatccaacagatctcttgagacgtattcactatcacaagaatagcatgggaaagaccagcccccatgattcaattacctcccctggtccctcccacaacacaggggaattctgggagatacaattcaagttgagatttgggtgggggcacagccaaatcatatcatggggtttggccagtctagcccaggattggctcgacttggctcgggtcattttgtgattagtgtgctcctcacatttcaccttttctgggcccagtaggccatccaggacatgtgcaagccagcgacactatgggcagctctgggagccagtttatataccaactcctgatggtacgtccagcctgctgcccaggaaggaagccagtgctggcacctggaaggcgcctggcgtgtatgggagcaccaagagcatggggagatgcactgcagcaggcagcacagacctacagtctgttatcacagtctcgctctctgtaataagcaggttaataaggtaataaggaggttacattgctgtttgaatttgctttccttgactaagcatctcttcatgctcaaaagtcttttacatgtcttcttctgtgaattcttttgtgtcatttgctcatttatctacttgtatggtttttgccttgaagaaaatgtaaattttaacttagttaaatgtataaagttttatcttcatagcctctggatttctttttttctttcttcccctgagatagaccttccctat

SEQ ID NO: 6470 - DNA, 375 bp, Homo sapiens
tgcgtgtcgatctgggggacagtttaataaactgccacacaacacagctgagctccacacagccacatgaggatggggacagccattccttgggtttctgaataacgtatcaagtgagcagtgaatttcaatcaagcttgtacatcaggaccgtcttgccaaaacaacagttgcttttggctgctggaagctgtagcttttcaaaacgttcacacatttcaatgtatcgtcgatgtttttaaatagacttacagggagggtggcacacagcaaaggcccgcagggacaaaggaggagacatagccaccagcttccaggccatccagggccccgggtcgccttgggatccggacccggtacaggccattcagggct

SEQ ID NO: 6471 - DNA, 616 bp, Homo sapiens
agtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggtcagttccctgagaaggtatcgggagcgggaggtttctgaatcagggtaacatggggcagaatctgtctgttgaggagcaacattatgtgcagctgcttaaagttttacttaaacaatctggtgctcgggttagttctcaaacattaagcttctgcaggaggttattacacataacccatggtttctgcagacaggtactcttgctgtggaaaattgagactgagtaggagaaagattgaaacgagctcatcagaaagttcttaaagtggatccttctattttctctgcttggggtttggtctgtactgtcctcctgccattgtcctcttcttattctgccagacagcaggtgctatgttctgaatctcaaaaattgaaagaatcttttgtctcaccagcagcgcccattgaaaatg

SEQ ID NO: 6472 - DNA, 3632 bp, Homo sapiens
agcggcacacagggcgcgccgcgctcgctcggcacgggcagctcagccggcctcacgccgccgtccgcaacagcagccgcgggcggggtgcagccacctccgtgagcgccgcagcccgccccactcggggcggggcccgcgggcaccggagagcggacggccgagcacgagggggctgcgcgcagctccgggcagggaccccgtctgcaccgggtggcctgcaagattgccggggtaggcagggggaggagaacgctcacccgttccggtctggcgctcccttttctccacacccacacgcctcccgctccacgctggcggcgcagctgctcccgctgccacagccgccaccgccgccgaagctcgcgccgccgccgctgccgccttggctgagcgcggtcacgtgacgcgatccgcggggagcctgggggcgggcgagtgcgcgcgcgcgcgcgcggaggaaccgcggctcggaccgggactgggagctgagcggcactgggagggcgtttaaggggaggacccggcgagcgcgccctcggctggcgagcgcgcgcctggcgattagaacttgccgcgcggtcgggaaagggtggccggagtgaggggcggaggtggggacttgcgcctccgcacgcccctccctttcttccttcccctgagcgccttggcttgccgctgcccccgccccctccagcgcgccccttccctcctgccgcagcctgcgattggctgagaggctctgacgtccgtgtttccatgacgtgttggtgcaggagggagcggcgggggaggagggggtggccaggcgcgcggggaggtgactccgtcagtcacagctgctgtttcggcgcggggccgggccgctgccgcgacgtgtggaggcaggagagcgatgattgccgcaggagaagtgcgggcgcccttcacctggggcccctcccgaaccgcccccgggcccatgcccctccagggcccaggagcgagccagcgggagggcgagggcgagcgctcctggcgaggacagattaaggcgaacccccagtcagcggacatttgagcggctcctcgccgcgtctctgcccccactccaaaccggactcgacgcctgtcccgggccgtgacgcacgcaccggaggaaaaagtgcttctcggctcgctccctctttggggaagagagctcactccccatgcgggcgcgggacactccatctctgttcctgccggtcgggtccgcaaacaccggggatcccagctgcggcgcccaaagggttaacgcaggcgttcggccagtgcaaaccggcctcgcaggatccgcgcttaaaatccgggtgttttcattttgggtttgtttcttctactatgccaagctggtggctctcttttaattctcttgtaacatctcaaccctgcacccatctttcctgaggggaaaaggaaacgggataacttgcggtatttcgatgctcaaaggtaaccggcggctctgctccaaccttcaagagattttgcaagttgaaaaaaaaaaaaaaaccatccttcgtaacatctacttaaaaaaaaaaaagcaagttttccttcttgtacacgcatatacacagtaaagatgtgtatcttacctaagataccgcgcttcatcttcatctaatctttatttgaactcaccgtcgccactggcccagagaccttgtcagtgttattttcagtatcagttaatcagaacaaaaagataagttctgcaatcttctttctcttaattccagaactggaaaattaatatttatatagcctcctcaaaagcatacaggcaataggaagtatggtattatgttcacgatctgatgatagcatttgttttaaaatattttaaaagattagacacaaaatgtgtaaaagacgtttaaaagtgaataaatataaatcaatgctgttgcaaataatttttttatcagtttatgtatctcactaggcttgacattaccagccttctgagctgtgcccttgatgtgtaagataaacgaacattgaacagaatgatagcatttttcctctcttcagtcactgatggagaattggttaatgtggtacaataaatagcccttcctgacactatttcaaatctttttaacagaagaataacctaaatttcacctaataaatttcaatattatttccccctaaaatatctttcaaaacgactcagagacatttaagaatcactggcttttttccaacttttcctccaaggaagttacaatacaatgttgaattatgtattctactttaatcaagaatttgacattaaagtaatatgtgaatcattgctatagtacactagcaaaatgggtaataaactagaatctgttcactttgtgggtttgttccagttccagattataaaatgaatgctcttaaagtgttgtggtcatgaaacaattattgagcatctttatttaagaacacgattcaattaagttttcatttatatcgataaatctataaatgaaacatacggaatatatatattcatgtatatccataaatgaaaacgtgtgtgtgtgtgtatcccggaacatatttgtatgcattttaatgaaatgtgagtcatatgcaatgacaaacttttactgtcatagtcaagaaaattgtactgtagtttggtttttatatttttattcttcaaataggaaataaagggtgaaagcaatatagaaataactgttcacattacattaagaaattcaatttttttctcccacaggcttagtactaaagcatccctcacacatatttttcaatgtaaaaatcaagaaaatattgcattgcttactgtttccttgaaaaaaaattgaactatctgaaatcaaagatgccactgtatgtaacagtattctcttaatcttagacctaacttatcccatgtgtttaactgatctagagatgtatctttgcataaggaacaatataataatacaatttactggggaaataatattttaaagttcttttaatatgcattttagctacaatgcaaaacttataaaagtatttaaatccagtcaggtgcggtggctcacgtctgtaatcccagcacttcgggagactgaggcgggcagatcacgaggtccggagattgagaccatcctggccaacatggtgaaaccccgtctctactaaaaatacaaaaattagctgggcgtggtggctcatgcctgtaatcccagctactcaggaggctgaggcaggagaatcgcttgaaccagggagtccaaggttgcagggagccgagatcgcaccactgcactccagcctggcgacagagtgagtctcagtctcaaaaacaaaacgaaacaaaacaaaacaaaaaagtatttaaaccccatgacaagttaccatatgagatgttaacattgaagagtggctgcagattcaaaataatatatttggtatttttaaggtatgctctttttcatagagtaaatctaaacaactgagatatttgctgaaaagttgatcgattcaagagatataacacatgaagacagttttctaaaatcctcaatgtaattaagtgtaaagagaaacaaagaactttattctgtcacatgcatctagcaataggacaaaataaa

SEQ ID NO: 6473 - DNA, 870 bp, Homo sapiens
gcgcgccccgcccttgcccagagtcttcccgggattggctgcgggcctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctg

SEQ ID NO: 6474 - DNA, 1051 bp, Homo sapiens
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccaggtaagaacttcaggctcctcttgatttcttaggcattacgtgggtataaccggacgaaacctgtgtgtgcaaggcagagcaaatttgtgtcttggcgttggaacacagtgccaggttatcgaccataaaggg

SEQ ID NO: 6475 - DNA, 1670 bp, Homo sapiens
ggacattcttacataaatgggctggtcatcctttagctaatggaagtttataaccagatgtcagatgttcacatgttcctactgaatgtttacctgaactcaaaatagtctgtctctgtgctccactcttctgctgcttatgcctgtttccacatggtccctattctgggcctggctactggcttctgcacttcggtacaaaatgaccattgtcactctccaggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaaaaaagagagcgatcattgtgttaagttatgtgggtgttttcatcagctaggagcaaggctgtggaataaggagtcagattctcagcttgctttcactttcaaggacttacagaggagtagtcaccagcctcacagcagaagttcagcccggcccccaccgcttcccccagcctaccccatagaaacgggctttgggctgacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatgg

SEQ ID NO: 6476 - DNA, 3016 bp, Homo sapiens
tgcctgtaatcccagcactttgggaggccagtgcagaaggattgcttgagcccaggagtttgaaactagcctgggcaacatagcaagagaccctgtctctatttaaaagattttatatatatatatgatcatatataatatatataagatatatatgatcatatatataatatatatatatatgatcatatatatcttatatatatatatgcagtttggaattctatttgtcttgccttatttgctttttaaaaatttctaccttagttttttcctggtttactttgagtgtttttttgtagtcggaggagattgttggtgcggctgggtgtaggtatgaggcagaggaggaagagtaatttattccatctactgagcctttcatttactttctgttttagcagtagagtgggatgtcggaagcttttgttgggtgagagtcaatctgtcagggtaaatcttaaaaagctggatttgtggtttagttactagttactgtgtctccagtggagacaaagattagtttttaagatttagccttaatggatgattcacaaattgcaatgcagagtattgaagttaagtccaaggtcaagcacacaagtgggtaaaactgaacatatgaaatgggtgtgtggctggcacccacctctgacctttactgaaataaatgaggaagacggtgctgtaagtggaatgccacggaccaggagttaagaccagagtcctctgctaggccctgcatctgaagtctgcagagcatggcttttcattggctcagtgaggagttgagtcctggttcagaaaaagttaccgaggtctgtaaaagtcagtaggataccggaacaagaaagagtgggagagtgtacagttcccagcgaacattgccagtggaggctaattttcaccagtgaagggcgattttgatagaaaagcacagtgtctcaactacttgtggtttttgattctgaaagaggaggctttggcaggagcaataatacacgtggcgctaattctagtacctccatccccgaatcgtctaaatgtattttacccaggacctgtcatggtttatctgagtgaccagtttcctttcctctcttgcttatttatcatgttcatatttatatttttcataatggggcctatttatatattttgaagtagttctagtgattttaagatccagcaaaacttcaaggtcatctggattttggtgttctatttaagttttctaacttgatacagtccgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaatttttttttttttttaatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttc

SEQ ID NO: 6477 - DNA, 452 bp, Homo sapiens
gttgcccgggactaggagcttaagtgaagagtcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatcccca

SEQ ID NO: 6478 - DNA, 2801 bp, Homo sapiens
aagtcagccttctctgaggaagcgacatttcagccgagagctgaaggatgtataagagtgagctaggtgaaaagtaggagaatattctaggaagaatagtatgtgcaaaggtcctgagtcagaaaggaggttgttgcctttgagaatttgaaaaaataaaggctggtaaaggtgacctagtgaatgaggatcaaagatggagcatttaaacacattcactaacactctgtaccaggtgctgattctaagtgctgtacaaatgtaagctcgtttgatccttacagcagccctttgaggtcgatactactatcacccccgttttacagattcagaaaaaggcacctgcccaggtggtacaggcattgtggctgcccgggcattgtgtctccagagtgctgctattacctactccattgaaataggacatgctgtggcctgggcagtggctatagcagcagagataacaagagaattgtgcaggtggaaaatatgttaaagagggggcagcagagaatttcagcctttagaggggttttagtggtgaattggctgtgaaggtggagcctagtttcttgggggacgtagtgtcacttaatagacataaagactttcggaggggctggtgtaggcaagatggtgatattttgacatgtgtcaggacgtggcaagctcttactgtgtctgaatccctagagtctaatgcataaaagatgttaaagtatttgttaaaagaattatgaattccaaggaggaaatacaacttaagccaaagtctggaggcaggaaagtgagacaggtttgagccccagcgatacttgccatgaagcaggagtgtggagtgccagaggtcattcccatctgtcccagcccttgtctcactgtcgtgtcctgggtgctcacccacctcccctgttggatggaagctcctaaaggcacacacctccttgggcttgtccgcagccttggtgtccaccacaggttttggcacatagatgctgagtgagaggaatggcaagcctcgcagccaatggaaagaacacctctgcagctgccactttgctccaagctgcatcgtctcttgcctgaattattgcagaagcctagccggtctcctgccttccacatgcccctccccccgtaatcttgttctcaacagcaaccaaagtgatcgtgtaaaatcagaagtcattccttgtttttcctctgggtggctctcattgtagtcactaaaaggtggcggtcttagggtgcctgacaagggctatatgacctacccccacccccagccaaacttggtctcttcctgctacccactccccctactccagctgtttttgttgttgtttttggtttgttttttttttttttgagatggagtcttgctttgtcacccaggctggagtacagtggtgcagtctcatctcactccaacctctagcctcccgagttcaaacgatgctcctgcctcagcctcccgagtagctgggattacaggtgcccaccaccacacccagctaattttcgttatttttaatacagacggggtttcaccatgttggccacgctgatctcgaactcctgacctcaggtgacctgcctgcctcggcctcccaaagtgctgagattacaggtgtgagccaccgcacccagccattccagctgttttgtgtttttcaaacacatttgacacatttctgcttcagggcctttgcactgggtgttccctctacctagacaaatgctctttccccggatatccacagctctcttcgagtcatttcagtgagaccttctcattccctcctatttgaaattgcaccctccacccctggaattccccttttctgtttcctcttttgtttttctccatgaaatgtttgcgcttctaaaatactgggtcctttgtccttcatctctcactgaagcgaaagctccagagtagctcccttggtgagtagtattcaggacataattgttggaaaatgggggtgggggccaagagcctggggctttcagcaggacctgtgtggagaatgcatttgatggagaagagcccagccgctgtaataacctgggaagggaacgatgaggtctttggcagggccatgggccagggactgagaatggttccagggggagtgaatctgaaatggtgctccctgcctgctacccacagacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaaccc

SEQ ID NO: 6479 - DNA, 555 bp, Homo sapiens
attgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacagaaaattttatcttgaggctctctaatctgctattgtccattgacttgaaagatgtatgggttgaggctacagttcttccagaagtatttgttaatttcatactggctttcctggcttctgttttcatggttttttaattcttgacctacagttgaaccataaatacctggttgatgaa

SEQ ID NO: 6480 - DNA, 1470 bp, Homo sapiens; identical to SEQ ID NO: 2329

SEQ ID NO: 6481 - DNA, 3790 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagaaattccctacagagtctcccaaaattcacatccaataaacagcctgcagccccgagtgacatatgtcctgtggatgacagctctgacagctgctggtgaaagttcccacggaaatgagagggaattttgtctgcaagggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 6482 - DNA, 1207 bp, Homo sapiens
gactggcgggactgcgcggaggcgactgcagacgtatcgggggtccggagcctgtcgcggctgctaagcgctcggcgcctggcgctggcgctggccaaggcttgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcagtctctgagatatgataccagctgttttgtggagtattttgccttggatctcctgatagagaacagggagtgccgtggtgtcattgcactgtgcatagaggacgggtccatccatcacataagagcaaagaacactgttgttgccacaggagtcaagaaacttttcttttgagctattgacagcttttaacaagttattatactcctatgaacaaaatttggagcatatttgtttctctctgcctgatttctcctgaatttggaaactatttgacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgag

SEQ ID NO: 6483 - DNA, 1859 bp, Homo sapiens
gttttctagcgcctctggtgggccgcctcccgcaggcctggtgtgagcctggggtccgttctcacagctggatctggggtctgaatgccgcgccctctggagagccacagatgggtctccgctgatgcttctctcaatttcctctaagagcgagagctccgggaaaggagccgatcctggtggaagactacaggtctgagtccactggacgaaaaacgaggctccttggattagagaccatcctgaggacatccttgggagccatgtgctgaagatggccaagccacaggatgaaaggagctgcatctttgagtcaccactggagaaaggtctctctaaatggatttgcagagacgtcttctcgaatactccccttctaagttccacttgtaatccacttcttctattctcccagcaatcaatgtggtttggggaaattccagaatctcatatcacgcagtacacatttgtcttccatgggcttcagttgtaagagaaccctttctactctttgctgttcacaagtctccttttaaacagagcttgttcccaatgctgttttgttttgccctctgccatgttcttccggccatcacctcctgtggggaaaagagagagagatcacattgttactgtgtctgtgtagaaagaagtagacataggagactccattttgttctgtactaagaaaaattcttctgccttgagatgctgttaatctaaccctagccccaaccctgtgctccctgagacatatgctgtgtcaactcagggttaaatggattaagggctgtgcaagatgtgctttgttaaagaaatgcttgaaggcagcatgctcgttaagagtcatctccactccctaatctcaagtactcagggacacaaaacactgaggaaggccacagggacctctgcctaggaaagccaggtattgtccaaggtttctccccatgtgatagtctgaaatgtggcctcgtgggaagggaaagacctgaccgtcccccagcccgacacccgtaaagggtctgtgctgaggaggattagtaaaagaggaaggaacgcctctttgcagttgagacaagaggaaggcatctgtctcctgctcgtccctgggcaatggaatgtctcagtgtaaaacccgattgtatattccatctactgagataggggaaaactgccttagggctggaggtgggacatgctggcagcaatactgctcttcaagtcattgagatgtttatgtgtatgcatatctaaagcacagcacttaattctttaccttgtttatgatgcagagacctttgttcacgtgtttacctgctgaccttctctccactattatcctttgaccctgccacatccccctctccgagaaacacccaataatgatcaataaatactaagggaactcagaggccggtgggatcctccgtatgctgaacaccggtcccctggacccctttttttctttctctatactttgtctctgtgtctctttcttttccaagtctctcattccacctaacgagaaacaaccacaggtgtggaggggcagcccaacccttcaacctacctatcttatctcttccattatctatccacatatgtcctctgtatttttttgagtaacatttataagcataagtccttaggtagctatgccacttacataatgaactagaaaaggtaaccaaacagaatagggttgtactcagatataccttctacaagtttgtgttacacatatttacacatatttaaaaatatatacatattattattgtgctgtgtggttattaggcaaactcaataagcagttcttataaagtatactcaatgtaacttttataaacttacca

SEQ ID NO: 6484 - DNA, 5176 bp, Homo sapiens
gtgggctaccacacctggctaatgtttttttgtagagacagggtcccactatgttgcccaggatggtcttgaactccttgcccccgggcaatattcctgcctcagcctcccaaagtgttgggtttacaggtatgatccactgtgcccatcctggatgcagactttaagcagagtcacatcaacaagaagagctgtgaaggtcagggcatgacccacagatgcccaaacactgcactggaggtccaggaagattctgctgacaacgcaaccctgagccaagatctgaaggataagagggagcttataacatggaagaaggaacagtattcctggcaagtggaacagcatgtgcaaaggtcaggtggtaagaggggcttcaaggacagtcctatggctggagcagagtgattgagggcatgtgaaatgagaggtggccagggtggcaggcagggactagcccaatggccgtgaaagggatgggactttggtcactgtttcgcatttccagatgtttactatgtgccaggcttggtactaaatgcttttctggaatatctcactagattctcacatagatgaagggcttgatcttagagaggttagatccctcagccgagagcccacagtgaggaagccatggggcctgtgtccctgactgcaagacctgtgctcagaacggccaggccacacagacctcaactctcactacaacctcctgaagtcggtgtggttactcttcccactttacagatgaggacatgggcccagagaggttatgtgagtgacacagcttgaaggtggagttaagcctgggcagtctggcttcagagtgtccacagtctcaaccactgcctcacatggcttcttagaaaatattataaaaagaagctcgggctgccatgtggaaaagaatggagaggggacaatgacacagctgggagcatgctgtgatggtgtacagcggacacattcaggatgaggtgaaacaggctggccctggtgagaggctagatggggctgggatgagggtggagacaagtagtcttggggttggcttggtgcagctggggggtgcggggagtgtctctgaggtgaggccgggggtatgggaacgccatgtttggtctgggacacggtgggcttgggatggctacaggacagtgcagtggagagtcaaaaaggctgctcggacccaggtctggcgagatggaagctggaggtcaggtgagctgtctaggagagggacagagtgggaaggagagggtctcgactcggctttcttgccaaaggagggttccgaaatgagaaactgtggaatctaagctggagaggaagaaagacggagaatgagtgaacgcacacgtgtgggacagatagatgaatattcatgtctttggctcctatgtacctgagtcttctaaagctgcaggccatactacccccgggaggctgcagggatgccagctgggagatgaatgcaactctgctgcctgggcatgggcctgagtgagggtgcagacccctgcctgtgatcatcagggagggtgatgagaacaaggtggctgacagggtgaggcccaagcctggagcttacccagctgcaggatcccttgctcgctctctcacaagcaaatgtagactgcgcaaccatcctgaccacagatccagaaagcccaggacataacagagccgcagtgcctgccctgatccacgcgcacacagatctagcccaggaacaagcccatccacggagtgagcagctgacaggggagccacgaacagcctggagagctgagcatgggcctgctccacactccagcggggcccgaggcccccgggaactctacccctcctggcagcctcacagaacctgctgcatccatctcaaaaggcatacctcctccaggaagccttccccgctgctcagaggtcttaaatccggggtctgcactcacaaactgtgcagcctacaccagcttctgggggacagcagaacactgtggggggcctggcacagtccctggcacacgagcctccctgccagcccagatggtcacaagggcctcctgggatgctgcccaccttggcagccaggcccctccggaggggccagtctgggcctgacacccccgaacaccaaccccctgggcagagcctgcctgtgcctgggtgaggaaccctgcagtctccttgccacacaaggcctgggtctgccttggggcccaggctgcaccctctccgacccccaggcccaatgtctgacctgtgcccacctgactcaacctggctactgttcagcaagtttacaaagtgttctcagtctgaacaggaaccgttttcaatcctttatttcagaaaggagagccaggagaactggggacttagaaaatacagatcctaaactcaaaagtccctgccccaggcgtgcagagccagggtcctggggttttgtgctgggcaggggctgccctgggagggggaatacagggggaggcactttaggacaccccttaggctgtggagggtgtcagctgggcctttgaagccactaaccactggttcccatcatggagagccctgtgtggggcacccaagggggtttcctcctggaagggcccccaacccaagtgtcagagaagctggcaagagctgagggagtgaggtgccatgacagcagccacagcctccagggacccaaacaggcccagctaccagcctggcactgagcatgccatctgctttaggccctggctggcgggcatgtgggcaacttgctccctcagtgcagggggctgggaggcacagatgcaggctcagcactacaaactcaaaacccccatgagagggctcagtcttatgggaaatgcctccaaccgagcccctttgccccaacacactcttcgtctgcctactgaagaaacttctgtaaatagcagagacttgagggaccccttcctggggtacgtgtatttgtatttttctgtttgggtgtttgtgtgtcccagtgggaccacctccccagggagacgaggcaggtgggcgggaggcccggcaggcgccgttacttcttcacgatctggatgacgtcctcatgctccatggtgtgggtcaggcccacccgctgcggactgtacttggtgctggtgccctgggtgaggaatgggggcagaggggtcacctcagcctggactggccaaggtcaaggaagatatccctgggcgtgtgtgtcctgaagggtaaatgccatggcataaggtgggggcctcaggcagcaggatgtccgcagttgtctgaccatccctgatctcaaaggttggggagggccaggcacagtggctaatgcctgtaatcccagcacttctggaggtcaaggtgggaggatcacttgagctcaggtgtttgagacagcctgggccagatagcgaaaccttgtctccatgaaaaattagccaggcatggtggtgtgtgcctgtagtcccagctacttgtgatgctgaggtgggaggatcgcttttgcacagatgtcgaggctgcactgggccatgatcgtgccactgcactccagcgtgggagacagagccagaccctgtctcaaaaaaaaaaaaaaaaaaaaaccagaaaaaaaaaagggtggggaaggcccatgtctaccctgggttggcatgtacattctatggaggacagacacacagacatgccaatccccacaggaaggacaggaacaccacgcagagagtgtgaatgccttgcttcatgcctaacccaggggctgtcctgggtctacccccctggttgctttccacccagagactcacccacaccagggcgtacttgaactggctggcgagtgaccggtggatgcggtggcactggaggacaggagagagtcaggtagagaggtcttccaggccctggtgggagacccaacacctcagcccagcgtccctggggcggaggccggcgccaggcctgcaggaacacttccttgacacagatgggaaggtggctgactctggtctgcagatgggttttgttttactcagcttgcccagcattgccacttgatacagatcccaagaagaaatgagctagaggaaaacaacaccaggaaagcatcagcccaggaggacggccatgtgacctgaaggttggccaccatctgtgcctgcagggtcatgttcaggtgacagaatcctggacagggaaaggcagcctcttgctccctgagcccagaccacctcccctggggcctgtgcatgcctgctcccctacctgggatgctccccaccccaactcttcactgccagacccactagtcctataagccggctcaggttgcctccttgaagccgctgtcctgacctctgtgttaagctggtgccactccctactctccttgactgatgcctgaatggcatggaagcagggttactggcatctctgcaaagccaggcagcatgctgagtgccctacacactggacctcattcaacgtgtcctcctgactatccagggggcaggcagcacacccccctcacagtagaggtcagagcctcggcacatggctaagaaggggtgctgcagacgcagccccaggctgtccaactccagagcctgcgttgacatctgagagtgagaccagcagagcccacccccagcccagggcacctcaggcagaacagagccccaaagggcatgcagagctcccaccccttgtcacggcaggtcttgtcaactcaccacgtgctccactgaggcccctttccggagaatgatggcgtctgtgaagtctggcctctctgcagggcaggatggggagaacgtcagccacacatcagggcccacactgccatcttgtgattctgcgcgagggaagagctggccacagaggccctttcggtctccttgccttggcctaacctccccctgacatccagcacaccctccacatagatccctgtaccatcttctacgaccttgatcttaacacagtgactcaaaataaatcacgtctaggattcacagtgcctgccacccatctgctgtgacagcactgacagagaccaggacctggactgaacgggcagggcgcaaagggatgctggagtctagtgagggaagctgtagctcactccttgccaaagtcagggttgatgcaaactgctccgaattcagct

SEQ ID NO: 6485 - DNA, 555 bp, Homo sapiens
caaagacaacctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatg

SEQ ID NO: 6486 - DNA, 497 bp, Homo sapiens
gaagatgctgaagaaacagcaaatcaaacttgtggtgggacagattccacggaaggattgtttaatatgggattcgcagaggcatttttggaacatctttggaaaaacttgcaggatccaagtaatcctgccatcatcaggcaggctgctggaaattatattggaagctttttggcaagagctaaatttatttctcttattactgtaaaaccatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcctcagagtctgaattttgagcggatagtgatgagccagctaaatcccctgaagatttgcctgccctcagtggttaacttttttgctgcaatcacaaagta

SEQ ID NO: 6487 - DNA, 1410 bp, Homo sapiens
actcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgtttacttactttgagtcttttgttctagcagctttgcctatgctacctaatatgaataagagcaatgat

SEQ ID NO: 6488 - DNA, 367 bp, Homo sapiens
gcgggcgccgctcttttgtttcttgctgcagcaacgcgagtgggagcaccaggatctcgggctcggaacgagactgcacgccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggc

SEQ ID NO: 6489 - DNA, 275 bp, Homo sapiens
cacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacagtctgcctgggccacagccctctcaccctggtactgcatgcacgcaatgcta

SEQ ID NO: 6490 - DNA, 2957 bp, Homo sapiens
tctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagcccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagtcctcggc

SEQ ID NO: 6491 - DNA, 546 bp, Homo sapiens
agagtggatgcccggggggcattcctgggagctggggaggggtagagtgcatattgggagggggctgactggtatgacccctgctgtgacctctcaccgcgttttcagtatcttcagctcaagaagaagttagaagatgagttccccggccgcctggacatcgtgagtcttgggatggggagaaagacttgagcacagccactgtgtcggtccgttaggcctggatggcactgcaggggggttaggtcagccctacgcccttcacccatgttctcatccccctgggaaggggagggtctccccaagaggacatcttagcccctccaacatctcccctaccccctttcctcagtgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagaggtgagggggcccactagaca

SEQ ID NO: 6492 - DNA, 1769 bp, Homo sapiens
cagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcagaaa

SEQ ID NO: 6493 - DNA, 571 bp, Homo sapiens
aacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgggtcatcaagattgtcagaaaaggcctggactacatgcctgtcccagcactagattgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccag

SEQ ID NO: 6494 - DNA, 6574 bp, Homo sapiens
ccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaaattttagttgtgactatctccaggtacatggcttgcgacaggcggtgtataaaaactaatgtcagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggactggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaa

SEQ ID NO: 6495 - DNA, 3625 bp, Homo sapiens
tgatatggtaatatgtccaaaatgtacagttgtatgaaagagcttgcaacacaatctatacataatatgaacacatttaggtaaaattatatatgtttgtgtgtgtcttctgtatgtgtgtaacatgattattttgcaaagagtgccttaaattatctcaaaattgtctcaagaacagaaaatttcaaggtggaagtgtttccaacctatttcttacagctcaacaaaatcattcatgcttttgacttttttcatttctatgtttcattatccttagtatgttagcctttcattatcagatttgccacttcatggtttgtaaggatgggttgccaagtttcagaaccatttccagcccatcagtctctggatacctccttcagtatgtgtgtgcactaggtctgcctagctcaccagtgtgccatagcctcagcttctaggcctttcttattttatctattgtcagtcacttcttccctgccctttttcacccctgccttatcctgcaacaccgagtcttaaaattccatctttactgcactccagtgcagttcctgctctgaagttgatgcttaacctttgaggaatgctgattaataaaagactcaattctaaaatgtttttctactcttttaaataaatgatattagaaaagaaaaaagttagattactaccatggcagacagtgttgtttgcctcctcaaccaccatttctttcctctttcttaactagtaagatgattttttaaaagtaccaaacaactcaaaaaatgtgagcttctcccaaagtaatttcatttccctttgaataagaatgttgtataggtgggcatatgggccaagggacaatcagcttcggagaatcctgcaatatgttttacccaggtttcaaaatatgtgcttacaatatataaagggtttttcttgaattactgttcaatatggtgaactcggcatatcatttgcctactatcctttcctacacaccatagaaataaaaatgaagaaacagaaaaaatgaagaataagtgaaggagtaaagatgatgtgtgcctgtatgcatgcacttacatgagtagaaaaaagtagatgatgtcaagagaagcaaatgaaatttcaaaaatgtgttgggatacaaagcaaatagtagtgatttgaccaaaaccatagcctaaaaaatatagtggagaagctacacaggatagggcagaagtgagaataagggctgaaaatggggataaaatatggcacaattgaatctatcaccatacacatttcgctttctcagacatatagactgagagcaagcaaaagatattaatatctgccaccagacaaaaagaccaaaactgaccccccaaatcttctccaaattaattgaataactagtacagaaaagtgaagacttttaggttgatgacacaaaggaaaaacattcttattcaagcattcagggccagcatcctgagaataagctaattgcctactcatgtaaagtgaaacttcatatttggcattcctggccctgtcctactatctgaaactagatttgactttcttatacaagcaaataatccaccaaagtttggggctgaaatatatttatccttaaagcattgtgtgaaaagggaagaatcattccttgccaactgttgtctttctatcattcctccaagagataagttaggatatgagaccccaaaccaacaacttaatagagttttcttctcatataataggctagtgatgggtactcctgaaattgtgtagttgctttctcaatttagtcatcccgggacgagagtaccttctttcttgtcactttgccatttctagagtgttgttttcatctaatagttcaaaatggctcacagtcatgaccatatatatttcaagcagcagtctaaaggaagaggagaagaaaaggacatatctttgggaacatgagttgaaagtacacctatcgaggaggagccgtgcgctgctggtgctgctggtgctgttgccgccgctgctctcgctgcagtcagtcaggctgcgcctgcttcttcagggcccagtcccttggacacatcgccgcttctagaccctcctgcagtctcggatattgctgggaaaatgtctgatgaattttcgttggcagatgcactacctgaacactcccctgccaaaacctctgctgtgagcaatacaaaacctggccaacctcctcaaagctgaccaggctccaacccttggaataatccgagtactccaccttcggtgccatctggactcccaccaagtgcaacaccctccactgtgccttttggaccagtaccaacaggaatgtatctctccgtgcctcccaccggaccacctccaggacccccagcaccctttactccttctgaaccatcatgccccccacctggtggtccttatccagcctcaactgtgccaggccctggcccatagggccatatcctataccaaatatgccctttccagagctacccagaccatatggtgctacccacagatccagctgcagctggtcctttaggtccatggggatccatgtcttctggaccttgggtgccaggaatgggagggcagtatcctacccctaatatgccctatccatctccagggccatatcctgttcctcctcctccccaagcctctggggcagcaccacctgttccatggggcaccgttccactaggagcctggggaccaccagcaccatatcctgcccctacaggatcgtatcccacaccaggactctatcctactcctagtaatcctttctaagtgccttcaggaccttctggtactccactgatgcctggtggcccccattcttaccattaagttaacaatggacgaagagatgacgctttgctttttgaagtacgtatatatgcacatgaatgcatatataaaaagtgctggtttcactattagagggcattcatgaaagaacaactcttgcacctctcagagaagataactgcctcttgtacttggtgagcatgactaattcctgccaattaggccaagctttctatttcatggataaaggtcattctagtatccatggcataaatgaggtctagggaattcaaaggctactgacagcaggggagatagggcgtaagtgggtaagagcaaatactcccattccctgcccccccaccctgttaacatgggtgaaagtcactttgacaaccatgggtggcaccctgttgcagttgccaggactcagggatacagtaacagaggaaagaaagagcaatgccttgcttcctctctctcatgtatcccagttatttgctaggaagagatgggaaccagggatgcctgctcccctctttctagatcattaggcattcatcttcagtctgtacccctttcgaatgcatcctgaacccctggggctcctttgaaacaggagtcttttttcttttttcctcctctgtcctctcttagataggtaattgtgtctttgtactacaggacactctcctcaaatgcatactccaatcttgccagagttaatttcccaaaccttagactggttggcttaggattgggctcgggggaagggaacccagaagcctgacatgctggcaaaagtaaa

SEQ ID NO: 6496 - DNA, 2381 bp, Homo sapiens
tcgatattgttgtgtctcagggaatagggaggtctaagaagagggagagactggaaaccgctagttggtggaacagttagaatatacacaagatttatcaattaagttcactgtcttatacgggcatggtttgcagtaccctaaaacaattacagtagtaacaaagatcactgatcacagaccaccatgacagatacaagaataaaaacatttgaaatactctaagagttaccaaaatgtgacacttacacaaagtgagcccatgctgggaaaatgccccgatagacttgctctatgcagggtggccacaagccctcaatttgtagaaaaggcagtatctttgaagcacaatgaagcagaatgcaataaaatgaggtatacttgtattctaattttctgccatgaaaaactgtctagagggcagtctccaaccctagggactagattgcttttgttttcatgcatgccctaaggtcacagagatgggggataacagtatgatgggagattctggtagggactcaaacctgatggtgttcagtagttgcaggtagactgctgctaaaagttggactttcaatttagaataaaataatgggtcaatgtatattatgtacattttctccatttcctgagtttagctttcaacagttaagatacttgcaacagcagaagtaacactacatagtgttacagtgtacaaatcccttgtcatttttattttaaaatatatttattacctcagtctctggctatattcacatagcgcaagggcacaagatcatcccttctgtttctctctctaaagctgagtaggttctgagtgaactgacaggcttgttttttttttgcccagaatgctaaccagtcctgacatggagggcaagtaaatttaaaaatcttaaattagaaataaagaatgatcttaggaaattatagggtcattctggtccagcagtgttttataactggcttccttctcttactagtcacggaaattattagagagtgttgcattttcctaatacggccctcctcagcacatgacatttaagtaaacaactctgtgtaagaggcagttataatagtttatataatataaactatctgatacacatatcatctgaaagcctgtatttctaacaagttgactatgtggaagaatagactagttcgcaggccagaagattataccgtagattacactggtaaagagcagaaattgttgacgctttagtacctagctgtcttaaagcatttttaaacatttgcacattactaataaaaagtttgaagttaacaagaaatttgacataaaactgagtaagctgtaaatatttcatatagaagatgtctgacacctgataaatgttacttaccaaatagaactgaaagtgagatgatcagaaaaagattgtccttgcctcaagcaagcttctgaagcctaggcaagttagctaggtccttaatatgggattctggcatcctgattttaatgtgctctgaaaacaaagtgtgtgactcatgaaataaaggacactaaaccccaaatttgaaattatgaaaactttaggccaaagaggtaaaataaaaacagctgttgggagtgaaaaatggctgtaggaatttagttacaagtacttcacaaaaacattttcatcacatttacataatatagcattacaatacaaagctggctgctgtcctgaccaagcaagttctcttatcatctaacaaaaataatttagatacatttctttgcatggaattgtcatatttttccatttttggtacaaaacatagaaaaaaacattggcacattatgtagtgataagtcattttttccccatgtacaagttccaagtattctgcattccaatttgtattggaaaaaagtaattactgattcaattaattcagtctctgtttgtttataccttttaaaaatgcagcatgaagtacagagaaagaaaaatgaagtttgtttacggagtctaatatttataatacataggaaggatcagctggtaaaagagaaaggaaaatctcgagtctgactttatgtagatcacagggagttgtgaaaagagcagtataaaaatatgcacttgtgctttagaagcttttagcatacaattaatagcttaaaatagtatttactgcctccccatatgcctattttctgatatatttacaccacacaattttaacattgttaaagctaatggcatgatttcaaatatagactggttaaaaatatctgaaccttgaaacttcccctatcccctcccaaaatattacgtatagatggtgcatggcacaacatactgcatgggcttacacccagaaaatttggattttaataaaaattttaaacatgt

SEQ ID NO: 6497 - DNA, 505 bp, Homo sapiens
cggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccact

SEQ ID NO: 6498 - DNA, 3855 bp, Homo sapiens
tggcagcacgccaggcctctgacgtcccagggctcaagcgcggaggacatgtggaactccactccaaaagcggcggcttgcggcggagctctctctagtgaggcggccagctggcgttcgtggcacacttgctgtcggctccgctcatctgttgggaatgcgtcctgtgggcctagtcctccgctggaagaaacgcgctgttctccccaaccaccgtttatcattcttattcaccgtctccggaatgtccattcagtttccgctcctgagagacttagtgactgaggccaggcaaagatttcaccttggggagggggaacgttaaacctttcctccagcagctttcgtgttttaaattgtattcatccgccatggaaagacatcagaagcccaggatctaagagacagactgaaatgaagaaagtagataatattgtgagaataatgaacaagctggtcactgaacagcagaaccgtaatggagtcccagttaaagggttttaactttatttcgtcactttttgcaagcatgatacaaagaaaacaaacacctaactacgctacggtttatagttaaaaggaaggtggaagatcctgagtcattacagcaatcacaaaacatgatggatttcttcatttaaaaacacaaaagaggtcttggcatagttttcaagggcaaagcatgacaagactctccagtgctttctttcatccccctctgtgtgcctttttctgcctgactcacagcctggctcaatcctaatctttctactgcaaagatgcagcatttaaagcaatttttcctgtgcagtatttgtagaatgacagatcctgccagaagctcttggaaacattttggaactatcttgcttttctgtatgttatgatccatctagcaccgttttcctcctgtggtagcaaatgacacttttttcaagcatcagcagcagaaatgagtctaccagatggaataagatactggtaaagggaaagatttgtttctaagactgcacaaatgaatgcacccaaatctgtgagttgattaatctgtgaagaaatacaactggcagtatttacatatctcaatgagtctcaaagtgtggtcgaggaagccctgggggtccttgggaccctttcagaggttccacgagctcaaatctattttcataaccatgctaagtctttatttccttttccactccagaggctatataatgtctgatgacatcatcgctttataggatgagagaatacgtgcttgtatattcttgtgtttgtaagactttccaggtttaatttattaccatatggcaattttcaataagtataacccacaaaacccaacagatttttggggcacctctaacaagggtcctaagaccaaaatgtttgaggactgctaatcgatattattcaattgtctagtcccctaaactccaacccttcttatcaggactacagagagaaaacaggtggtcttcttgacaatcgctttgtatttacattcagtgctttagtagaagagaagaaagaaagagaaagcaagccagagaggcctcggaaagagaagcctacttattaaaaatagctttctggctggtcacggtggctcactcctgtaatcccagcactttgggaggccgagacgggcggatcacttgaggtcaggagtctcagaccagccaggccaacatggcgaaaacacgtctctactaaaaatgcaaaaattagccgggcatagtggcatgcacgcctgtagtcccagctacttgggaggcagaggcaggagagccacttgaacccaggaggcggaggttgcagtgagcggagagcgagactcgcgagtactcgtctcaaaaaacaaaacaacaataacaaaaacagctttccatcccttccctgaggcttgggtacctgaaccacgttaatctgtaaatcactgcttctgtaacttttccttggtataaatcacataggcaatgaggttgggtataaacagtaattgtccttgaattgggtagatgttttcttattatttttgtctaagaggtcattgcgataggcagaattctaagaatgatccccagtgacgcttgcccttgtataacccccacccatttgagtgtgaggtgaaacctatgaatttgatgaggcaatactcctgttattatgttacgttttatgacagatgtgagattttccaggtgggcccaatctaatcacaacagccctttaaaagcagagattttccgtctgctaagagcagaagaggaagtcagagagatttgaaggatgagaagaatttgacgtgctgctgttggagggggctacataccaagaaatgtgggcatcctatagcaactgaaactggctcctggctgacagccagcagagaatcaggatatcagtcccagaatcataaggaactgaattctgctaaaaacctaaatgagcttggaagtgggattcttccgagaagagcccagccgggtcaccatcttaattttggtctgcgaaaccgtaagcagagaatccactcaagcccacctggatctacagaactgtgagctaagctgatgtggtaatattttaaagccgctaaatttttgttcatttgttgtgcagcaataggaatctaacacaaaggtaaatagaatatattttttaaatcgaggcaatattcacataacataaaattaaccattaattaagtgtacaacccagtggcattactacattcataatattgtgaaaccatcacttctgtctaattccaagacattttcaccaccctacaggaaactgatacccattaagcagtcactccctgttccctcctccccttagtccctggcaaacactaatatgctttctgcctatggatttgtctattctggaggttacatacaatttgtgaccttttgtgtctagcttctttcacttagtttaatgttttaaagattcatccacattgtagcatgtatcagtacttcgttcctttttatggctaagtaatatgtgtatatacaacattttgtttatccatcaattgataacatttggattatttttacttttgtctattgtgaatagtgctgctatgaacatttgtatgcaagtgtgtatttgaatatttatttttatttctttggggtatatacctaggagtagaattgttgtgtcatttggtaattctgtgtttatctaagaaactgccaaactgttttccacaggctgcatgatttcacattctcataagtaatgtacaaaggttccaatttgtccacatccttgccaacacttattttcctttttatagtagccatcctggtgggtgtgaagtggtatctcattgtggttttgatgtacttctctaatgactgatgttgagcatcttctcatgtatttgttggccaatcatataacttctttggagaaatgcctattcaagtcctttgcccctctttgattcagttgtttgtctttttgttgttgagttagaagagttctttataaattctaggtactagacctttgtcagatatgatttgcaaatatattttcttccattcagtaggggtaaatagaatattgagagactttttatatagtaatataaaaaagcatgaagggatgtgttttgcaaaaagtaagattacacagtattatacaactatgttatacactttggctcttggttttctctctaaggaataactcatgaagaacattccatgtgttaaggtatacctctaattctttctaatgcctacataatatcctattgcatgggtgtgctattcaccccctacttatggttattcattctgtttctagtttttggccactgccaac

SEQ ID NO: 6499 - DNA, 6623 bp, Homo sapiens
ccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaaattttagttgtgactatctccaggtacatggcttgcgacaggcggtgtataaaaactaatgtcagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggactggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaa

SEQ ID NO: 6500 - DNA, 500 bp, Homo sapiens
gacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgataggtaaataactttgctttgaaaaagactcatgtattttttaatttcagagtgaacttttgctctaaaaataacaaatttgattaatatagaatctaatttttactctaattatatctctcctctgttttgaaagattcaaacaccgaaatcgatctttttcaagatctaaatccaattcaagatcacggtccaagtcccagccca

SEQ ID NO: 6501 - DNA, 1006 bp, Homo sapiens
acttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcaggaaaaatctatcttaatgaagctttagaaatgtacttttagttcaatagtatgagacttccttaaacaatactgactttgcatttaagtaagccgccaccagggctactgctacccatctgcacaagcaaagtgaatgaagaagaaataagtctttcctagacatgcaaaagctgagggaattcattaccactggaatggccctacatgaaattcttaagcgagtcctgcatttggaagcataaagacagtatctaccatcatgagatcacacaaagtataaaactcactggtagctcagacacacaaataaaaaagagaaaggactcaaatgttaccagtaaatgttaccagtacagaaaaccaccatatctcattgataaacaataagagataaagaaaggacaaaggatacgtatgcaaaacaaccagaaaacgattcataaaatgaaaggaataggccaggtgcagtgactcactcctgtaatcccatcattttgggagattgaggcaagcagattacttgagcttaggagtttgagaccaatctacgcaacatggtgaaa

SEQ ID NO: 6502 - DNA, 285 bp, Homo sapiens
gaagcagtgtgttagctgaagtttaatgaactaattggtggtcctgggatgcagttgggaagatgggatgattcagcctgttgggatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatg

SEQ ID NO: 6503 - DNA, 1780 bp, Homo sapiens
cagcactttgggaggctgaggcggggggatcacgaggtcaggaaatcgagaccattgtggctaacacggtgaaaacctatctctactaaaaatacaaaaaattagctgggcgtggtggcacgcacctgtagtcccagttactcaggaggctgagacaggagaatcacttgaacctgggaggcggagcttgcagtgagccgagatcgtgccactgcattctaacctgggcgacagagcaagactccatctcaaaaaaaaaaaaaaaaaaaaaaaagatacctcagttaggttatcagtaaaaggggattgcaaatatcttttaaataaaaatttgcattctatatgttatagaatacagaggatattaaaaataaattttatccatgttttgacaatttctttctttcaactgtttacatattgaagcacaaatgctaaacataagtcagaatggaagaatatttaaaataatgactgtgtttatatctgatttatttcagattgcccaaagtgcatcttgccaggttatcttccatttgaagactgacattttatttcttttttgatctttattgttcctctcttccacctctcagtgggtatagctctctggtctgtagaatgggacagtggtctggtttccagattgataagtgaggtatacctcctagttttcagtaattacctgtagaaggtggagaagttactggatatgtttaataatatctcattacattcttttttttttttttttaacgagagtcttaactctgtcacccaagctggagtgcagtggtgcaatctcggctcactgcaatctccacctccgggttcaagcgattttcccgagtcatctttccaagtaactgggattacagctatgtgctaccatgcccagctgagttttgtatttttctttcttttctttcttttttttttttttttttgagacagagcctcactctgttgcccagcctgggtgacagagtgagactctgtcccaaaaaataaaaataaaaataaatgaatatataaaataaaaaatatatgtatacatatcatatatatatataaaataaaacttataaatagtttttatggctgggtgaagtgactcatgtctgtaattctagccctttgggaggctgagcgaggaggatcacttgagcctaggcattcgagcccagcctgggcaacattgcaagactctgtctcatttttttatataaaatgtttttttaaaaaaccctatgtataattatttattttttttccccaaggattattcccaaactatgtacaattaatgggttgccttgcagagttggatcaataatacctgacacacttgtatagcaagcatacactttacatagttcctcgcatctattctttgaaacccagacacattctagtattgggcactagaaactggtgataaataataacaattacatatatttcctgaagaattatgtggcattccttgttttaagcacctttgatgccttagctcaatctccattacaatactatgatataagtaccatttaatatttctttttgacagatgggaataatcgaggcctagggagattaaattacttggccaggttcatgtaagtggcagatctaggattcaaattcagccggtctgaatctagagcctattcttttagctatgatgctatactttaatacagtaatacactgttcaaatgaaactgtaacatgtcattaaatttgaacttgtcaataaacataccaagcaataaaataa

SEQ ID NO: 6504 - DNA, 1220 bp, Homo sapiens
atttcgggacctgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggattttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgta

SEQ ID NO: 6505 - DNA, 2608 bp, Homo sapiens
gtggtcctgtgggcctctgcagtggacgcagaggcacctgctttctggcctggactttcctgtcagtttctcctgcctgttcaggatgtcctgctcagtgcctgtgcctgaagaggcacagaattcaggaggtctctgtagggagctcattgttcactttctcaggcaaaggtagtaaacactgctgcttcccaccggcttcaggttcttcctggtgattctgtccaatttggagctcccaaacaactgatttgcctccttgatgacgataattcccagaaagcaggtgatgttagagacagtgctggttagctaggctcctatttcaactaggtctcatcctagttttctgcagtttggctgcaggtttcttgcccttttttttcatctcaaatactgtttattacatgacaggaaacatcattggatagtgaacctatgttttcaagattgtttgcagtttttttgatactctataagttacttggtaaatactatgggattcgtttcaaaattgtgatcacttgtgtctggagatatgtgcttggaggcaggtacatcctctgctcttttgctgtagctaagggtgaattattgtgcagtttaagcacacatagcacacataggcgtggctgattgttggcctacatgtgcccagggcattgtttcatacattacatcaattcacattcacaagtaccccttggctacactgggatttgagttcaggacagtagggcctgatcctaaagtcaacatttttttgccctcttctcctaccactgaattcccttcctgtttcttgatccccttactgaatcctcttttctctcctcataggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaattgttttaattagtttactagttggctgggcatcagaagctacccagacccgttgtctctctcatgtttcaccctcccacttctgccccaactctgaatacctgttgcagggagaaactgctgaagcagcactcccagctagcctctcagaagccgtgtagggcagttctctcccactccacagggcgactggtctttggaaagcaggcaggaagagctcaggtctggcctgaagcttctctcactgaagcctgtgcagtcagttctgatacctcctgtgacttctgctctgggtaggttcagggccctagtagcaggagagatgatcctgaatcctgttgaagctggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggatacccttcccctgtcccactacgggtggaggctaaggacctcctcagatcccacagattgcctggtgacattgggcacagggctggatggtgtgctgtttgagaggacagcatgctcaggagatttcagtgggaatgatctctaggctgatgtgtatttggggaagtgggggtggggaagaggtaggtgcctgctgcctcaaaccaccttgtgtaaaatctgcaatacggcttcttccatgtacctgtgcctgaactgtctgcaataaagaagaatttgtaaa

SEQ ID NO: 6506 - DNA, 759 bp, Homo sapiens
tattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaatgtaagttgagaatttctaatttacatcgggatgtgttctaatgcgcttgtttttaaaactgtggaaaatttttaaaagaaaataaatctcaccagtcatccagctacccagaagtaacattttcatgcattacctattaatttttttctctgcatattttttcatagttgagataatttagggaaaaccattttgtgtccttcatatatggatgaatacaatataattttggtattaatatcatagcaacaaagaaggcattgaaggctttaaatctgtttacagtgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccact

SEQ ID NO: 6507 - DNA, 825 bp, Homo sapiens
ccagcgatggcgccctggcggcgcggaagcccgcggccaaatgacacgacttgggggcaaaggaggacaacagttcccaccaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttaggaaaaatatattcagggggaagagatgtaatagatttcacattatggcagttactaaagaagcacgtgaacagacacatcaccttcactttgggatatggaatttgataagcagttagccacagaatatgaacaaccccttgagaatgagattgaagaactgatccaggggacaaaagaggggaaactgagagttcccaattaataatgaagcagcttcatatctaagatctctggtggactttttctgcccgtggacgccgctgaagaagcatcgttaaagtctctcttcaccttgccgtcatgtctaagtcagcgtctccaaa

SEQ ID NO: 6508 - DNA, 547 bp, Homo sapiens
cccaggcatatgtccctgccagtgtaccaagggacacccccagcctgtggcttatcccagtggctggctgtagatcccacattttgtgactgaggtgacaggggcccacagcggggccatgacagtgactgtctctttgcttcagtgctcatcttttttcccctcagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacaga

SEQ ID NO: 6509 - DNA, 4533 bp, Homo sapiens
gctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtgagcaggttggatttgaaaattttcttgcaggtaggttataaacaaaggtgatctatttcaaaagattgcataaaacttgggatattttaattttaattcctgaatgttattctctttacttcaaaaattaaaatttctttttagatccaatgccatttaactcatttattcaaattttattttaatgtttaaagaaaatatatattttatatattttagactttcttcctgaagctattttagactttattcctgaagctattgaagcaactatctaaaatcttactgcattttcaacttaagatctgctaggttctttaacctgcatagaatttttaagtacataggtttgaaataactatagtctatgtttatgcgtgtaattatctttgaacttataaatcagttctttttagtatttctttctcactacctgaatagttaaactcggagtatattttatataacaatgtcatgataatgctcagctctttgttcttttgtggttttttgatgtgctagaatgcattgcacctgaaattttggctataatgttagactaatttgaggcctcataatttatataacataatgtgaatccattgagataggatcatgttacctggtgcttatgactttattagtgttaataaatgttcagccaggtgtggtggctcatgcctgtaatcccagcactttgtgaggccaaggtgggagaatctcttgagctcaggagtttgagaccagccagggtaacaaagtggaaccctgtctctacaaagatatacagattagctgagcatggtgacatgtgcctgtggtctcagctgctagggaggctgaggtgggaggatagcttgagcctgggagggaggtagacgttgcaatgagccgagattatgctattgcactctaacctgggcgacagagccagaatctgtctcaaaaaaaaaattaaaattaaaaaacccaataaatgttcagtgctgttctggcatttggaaattagttaataattagtccctcttgctttttttggaggagaaatactgtattacttctagttgatctttttaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgataa

SEQ ID NO: 6510 - DNA, 579 bp, Homo sapiens
cgctttgtagcccaggctggagtgctggtggcacagatcgtggctcactgcagcccagaactcagggctcaagagatctttccaccttagtcttagtctcctaagtaccagatactacaggagattttggactctctgcagactgtccctggatcttgggttaaaaatctgtattctagactgaaccgtgggaagaaaaaatagtcaatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctt

SEQ ID NO: 6511 - DNA, 542 bp, Homo sapiens
gcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtaacctactttataatcaaaataatcttttctgtgaagtcggatgcattattcaaggagctattgaatttaatgtggtgtttttatgggaacatgctgataaaaaaataaaacttatggctcctgccgtgattatgttca

SEQ ID NO: 6512 - DNA, 1478 bp, Homo sapiens
aagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttatggaaaatttttgtacctagaatttcatagtaaggcagactgtcaagaagaacatcaaagtgaagacattttctgtcaggcaaattttcagaaagtctccctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttcataggtacatttccttttctatggcacaggcatgatgatattgggtgtgtagggaagaaaatatcctagcttatactaggctcccagtaagaagtatttaaatagccaaaataatgtggatatcatttattagtattcagtgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaat

SEQ ID NO: 6513 - DNA, 539 bp, Homo sapiens
ccaggatcagcagtcttctgctgccttcttaatgtttcacctaagttcccatagttgctctcaaaaagtttcttggccctcgtgggccagtgtggaggggctgtatcatcattcatcaggagcgtcacttggtggtttagggggaaataatctattcttaagattgaagagagtgcaggatttggggggttgactctacatccttcagtatcagagcttatctccttgtcttacctcctaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 6514 - DNA, 780 bp, Homo sapiens
attttgtaattgtagggacagggtctcactttgttgcctaggctggtctcaaactgctgggcttaagtgatcgttcctccttggcctcccgaagtgctggaattataggtgtgaaccaccatgtctggccttgtagtttatttctaagttcaaattaatgttggtgcttttcctccttttttcttagcagatggtttgctagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtttccttaatgacaacaaaaaagggagtaatcctacccactgtaagagtcatgactcttgattgcagctgacagaaactcatgacagcctgctttagatgaagggggagagaaggactggaagaatcttggagttgggaatgtcacacgtaattgaaggaagaacaagaaaactataattcttcccctggaggctggagtttccaggatgtcaaaattacctctgcttgggtgagctatttcaagcagctgggatacctgtgtcactcctgctgtctgccagtgactgcccaggtgtctgctggttcctccc

SEQ ID NO: 6515 - DNA, 3345 bp, Homo sapiens
cggcggcgcaggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtct

SEQ ID NO: 6516 - DNA, 1856 bp, Homo sapiens
ttcattccgcaagcccagccccaggtctctgagtgccaccctagaggtgttaaacaaaggaggccaggcaaagtcccatctccctcagggcctaggcttgagatcacagcaggaggagccaaggagactcacgattaccctcctgaatcccttcagtcactcacaagtggcaatgctgggcaagctgagtaaaacaaaacccatctgcagaccagagtcagccaccttcccatctgtgtcaaggaagtgttcctgcaggcctggcgccggcctccgccccagggacgctgggctgaggtgttgggtctcccaccagggcctggaagacctgtgggcatgtgggaggaggagtcacattgcacaattgcagagtcccctccccaccgccctccactgtgccaccatcagcgtggcaaccagaggtctacactctcagggcaattgctggctgcctcctccagggtctccttccagttttatatgacatctgggacccctgggatcttcacccctaccaaggagcactgaagtttatacactgccctgggagttgggggtgatgtgatgtgtgggaagcttcaggccacaggtggggccaggaggagtgagagatggtgaccaagcaggggggactccaagctatcaccctgtcccattctaaaggagcatctgttcaggcaaggcaagcagagggccactagcagccaggcccctgaccttcccctggtggctttgggaacattcctaactatgcaccacagctggcagatcaggagtgggaatggcagggccacctgcagctgtgattgggtggctatgtgcgaattgagcacgtcagtcctccacacaaggcccagactgtgtgggcacctgccgcgggaactcctgcctcttggcctgtgtcctgagctttgggtgtgcagccaagcttgggatggggttaggtgaagcctcacctctctacctgactctctcctgtcctccagtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacgg

SEQ ID NO: 6517 - DNA, 6860 bp, Homo sapiens
caggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacaggaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttaca

SEQ ID NO: 6518 - DNA, 582 bp, Homo sapiens
aaaatagttttaacataaaccgttttcaacttggtaagtggaaaacattttggtttccaccataagtggcccacacaactctgatttttttaccttaaagcggcgcagaccccgcccactccagccattccttcaggctgcccgggctcttctctccgcgcatgcgcagtttcctacaggcccggaaacggatcgcgttgggtgaaggtgacggcgtcgagcgtgagtgaccctctgtgtagattaaacctgcgctccctgtttcccatttccacagccgatgtccagggtcgatacggcccttaaaatccccgtacactccaccccagcattgacttccaaagactcctggcacatgaggaagaaacccagaagaggagagcaaaggagtcaggaatggcttttactcagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatg

SEQ ID NO: 6519 - DNA, 545 bp, Homo sapiens
aagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgttgtcgttccccctgcttaaagcacttgatgcataactctgtctaccttcattccgtagtaagacagagacgcttggcttcagacattttcctttgggtattaatgtgtaagttgtgctacaacataattttctcttttt

SEQ ID NO: 6520 - DNA, 5834 bp, Homo sapiens
cttcagagagattgccttgttcaaagccctatggttattcaaatggtagagccaaaaatttgatctatgttctgacttaactccatgggctttggaccttggcagaggaaatggtgtctttgaactgtagtctgtagtcctagaaattgaataaactatttcctaaatagaggtaagagactaggatcctagcaacttctctaagttaacaaaaggggaaaaatatccccataccatttttctcttcattctattaatgagggctagagtcgtttcatagattgaatagtttcaagagcatattgagcagtgcctggctaacagctgaaagtctgccatttcatgcaactttgttaggctttagaagtgaagcaggaatatagagaaaatacagcttctcccacccacaacgtgtattttaaaccatttcttctggcccagaagacaaacttttccaaatatcttgggaaaaccacagtttctactctttggagacaagagtctcactctcacacccaggctggagtgcagtctcaactcactgcaacccctgctctcaggttcaagtggttctcctgcctcagcctcgtgagtagcactcgacaccacacctggctaatttttttgtgttttttgtagagatggggtttcgcgtgttggtcaggctggtcttgatctctggccacctcagccttccaaagtgctggtattacaggtgtgagccactgtgtctagccaagtttctactcttgatgcctgccatggactattacaagcacctggcagtgacattgcacgagttctaaagaaagacttggtctttcccacagggacattaatgtgaaagaggtccagtgacaaagattcagtcacttttgcagaccctcacaagccacaataatgaagttgcagtgaatttgggacatagccttccctccccaaaattcttgatccaagaatccacccgtcaagttcaatgactcagactccatttctagtgtggtcgttggttaacaactttactagtttccatccaggcttaacctttctatggaccataatgtcttggtgtctgctgcatttattgtccctccctgttttaaggatacttaagtttttaaagaggcataaatacttcaaagtccccattggccctcctgggggaaattacctcaaaccacagggtagtctgctaaataaccagctagagctagctgccagcccaactttgcccagatctacaatattattctcgttactttagtttactcatccccccaaacttagctttcccccagaactttatatccactctccataaaagcttctgtagcaccagcttggtcagtcccaaggtcccaggtgccactggggtctggttgacaaaattgttggtatggtttggctgtttctccacccaaatctcatctgtaattgtaatcctcataatccccgtccccaggttgagggagggactcggtgggaggtgactggatcatgggggcagtttcccccatgctgttcttgtgagagttctcatgagatctgatggctttatgaggggctcttccccctttgcgtcctacacaaaccctgtctcgcctgctgccacgtaaaacgtgcctgcttcactttctgccatgattttaagtttcctgaggcctccccagccacgcagaactgtcaaacaagatcctttataaattacccagtcttgggggggttttatacagcagtatgaaagcagcctaaacagttgttttcatacgtgctggaaatgctgtgatctgccctgccattgtccccatcctggactgaccctcagtatttttcctttgagtggtgacccagctctttgccttgagcagcaggagtagcccttggtagaatctagttccccaggggaaatcaaagcagctttatcttctcactgttagccaagcacctctggagacagccttagtgtttgctcttttatcccctctcacctgggaatacaattgcccctgcaacataatggccctactgttccctcaccaactcccccagcatggggatcagaaatatggcagtactcctcagtgaagtatatgctgctttgttttaagcactcacctgaatgtgtaaggacatctttcctcaagagcttctcacttcctgaggagtctgtagtcttcattcaaatgtcttgatggctcattttccagaaatctctgtaggtcttgagaagcattgtcctagctttggtttatctgaatagtcctatttaaacttgtcccacacagatagcagcctcttgcttgcccttctgtttgtacacttgtctattttctctttctttaaatgccttttgggtgttaatacttcattggtggttccatagccttgtccccctctcttttgcaacttgaaggcaattctcagttctcttcttgagcacattcatacttagcagcttctgaatatcccacccacaattaaggtacaatctggtcacataactttttccctaggaagaaatgtgctactcaagactaatagccaaggttaagaacgtgcatactcctgaatcggatgtaaatgcattagtctatttgttctgtttagaaataaagatggaacatattttatagctactgttagtgcccatgtgccttctaaatatcttttgaatagttttacttctctccatcttgacagctaccatgccaatccaagcttccatcaccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgctacctcgcccggcttttttgttgttgttatttttagtagagacggtgtttcaccatgttggtcaggctggtcatgaactcgtgaccttgtgatccgcccgccttggccttccaaagtgctgggattacaggcgtgagccactgtgcccggctgttcatctgtttttcaatacctttaagttcagtttcccttacaaagcccacttttttcttagtgggaatctcttgtaccacttaacacctacattccttaatttttaaagttaaaacacttatatactataaaatggacacatcttaagcatacagcttgatgaagatttacaaagtaaacatgccagttgaaacaccactctgatcaggatgtggaacataaccagcactccagaaatctctctgccatcattaccaccactggttatcctagccactcttctgacttgtatcaccatagataggttttacttgttttgaagccatctataaatggaatcatggaagtttgggcttccctgagagcagatcttcagagaaaaaaaacttgagtgcagtagtttatttggcgtttggctccaggatgcaggagtgggaaagatggtagagagacagaagaaaaatcaatagaaaggtattacggaggttggatatataatgcttcccagaattgtctgactgaacaggaggctgaaatatttatccgctggctcctgtttccaattgattgagggatgcccccaaggaagttaacttcactgcaattctgagctgtaattgactttaataagctccaacagcactgaaagacgtttggattattttcagtttgggataatactactatgaacattcctgtacatgtcttttgagaacacgcatgtgtacatttgtgatgggtatgtaatggggtggaattactggttcatagaatatgtgcatattcacctttagatatagaggctgccaaccatttttctgaagtgattatactaatttatattctcactatctgtaaatgaacatttctgttgctccacatccttgctggcacttggtattgattgatttctcttttaattttaggctttttaatacgtgtgtagtgatatctcacttgctgtttgtttgctttttggtaaattttttattgaagtataatttacatacagaaaatcacacaaattgtgtacaggtgtgatttttcacaccgtgaatacatgcaaaaactagtatgaaattaagagttggaacatcaccagtactccagaagccccatgcatgttctcttccagttactataccactatcccaaggatggtctattaattcaacagcatagatttattttgcctgtttttcaacttcaaataaatgaaataatatgcactcttgtgtctggcttctttgactcaacagtatgtctatacaactcatctgtattgttgcatgttgtagttcgttcattcatactgttgtatacagtattgaattgtataaattactcattctgttactatgcatttgggctgtttccagttttggctattatgaataaagctgctatgaacattctagaattgtcttgttgaacatatgtatttctgctgggtataaagcttaaaaaggaaattactggaaaataagagtattgcctcatgttacctacctgctattttcactgtaatttcatctattctggttgatgtgtaatagtgtcatattagcattttttctttgcttttataaaataaatgtttttatgttggaatgttagatttacagaaaagttacaaagacagtacagagttccttatatacccttcatccagtttcccccttatgttaatatcttaatgttaacatggtaactttgtcaaaactaagaaaccaacactgactggcacattactattaactaaactccaggtcttattcagatttcaccagttcgtgtgtgtgtgtgtgtatgtgtgtagttgtgcactttaaccaccaccataatatacagaattgttccgttgccacaaaggaacccttgtactacccacttattgtcacaccttatcacccatccttt

SEQ ID NO: 6521 - DNA, 2635 bp, Homo sapiens
ctagtgatccaggcccccccccaggactgccctgggaagccactgtccctcccactccagtagggaacactcactggctgggaaaagacaatgtggatcttcttttgggctgaccaagccaggagggcacaccctcccactgcccctctctgcctcccactgattgtccctcagcctgatggggtgtgacagctgcaattagaggcaggattccttcccaccctcaaagcattaatagccagttggagaggcaaaatagtaagaaaaggctcttctgcttgcttcctggatccctggggagagtggagagaggggcagagctcaagatgggattatgggggcgcagccgcggtggttagggtcactctcaaatcctacccagtcaaatggtaagatgtttcatttttggtgggggagctgcaggagggaggaaggcgctcatgctttttgggttttgttgagcactcactgtctgtcaggtaatgtgcacatctctcaaacttagaaggaccctagaaggcattgttctccagacacatctatggaggttattagggggcgtgtaaactgccccgattaggctgctagcaaaggaaaggacagagatttgaacagagggttgggttatctggctccaaaacccctgtccttttcttgctatttctctacctggagtttgccaactgagcaagcccactctggtggagccagccactgcaaatcctttgtgtcttcccagagaataccaacatttcagttttgagtgagggaacgttggctctgactgcctttggaggtggagatggtggaggtggtggtggtggtggtggtagtggtggtgtgtgtgtgtgtgtgtgtgtgtgtgtgtgtgtgcctgcgcgtgctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacactgaaagcagttgctcttgttttacatggacaggctcagagaagttaagcaacttgtccaaggtcacacagtagtggaattgagattgaatcagttccaactgacttgcaatcttgtgcttttcagacgatcccactaattgtccatatctgttccaaagccaaatcaagaggaacaagagcaaaatctgtcctctcatattattcatggtcctgcgtggatcataaatggcatgctgactgtctgatggagacttacttttcccttccccctggacacctgccatggcaatgacagaggctgtattttactgaagtggagggaagaggtgaatgcaaatgcctagggcctaagtatacaggaaggtgtagggagaggtaagcagtgtgtatgtggaggagatagcagacgtaagcagagagaaatcagagagcttagttcttcctctggggcgcactttgtggttaattaggacatgcaaatgagctagaagctcatttaatatcctccctgacatgtagccccaccccaccctgccccacttccctggcaggtacaagggccacctgattggcccaggtatctgtggaaggttccacctgcttctttgtggcccagggaacagaaaagagtccctgctgggcatgctagtggggccggcctggtctccctcctccctttctcttcccaacctttcagacttgggacctctcttttccctctccctcagacacttcccttgtgccccgcccctcagggtgatctctgaacccaaacttgccccaaagaaggttgctctgtcctctccacatccccatctcctccctagggccttgttggggagaggctcctccatctttcccaagtcacaccatcgtttcctacgtggtctggacaagagcaagagcacaccttgtccccaccttctccagagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctg

SEQ ID NO: 6522 - DNA, 470 bp, Homo sapiens
tttgaattgaagtaatctacaaaagaaatgtggtccagactttagactttgttgggactgtgatgatcatttctggcttttggcaatctggatctgaacctttggttttatttagctttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaagctgtttttttcagagatgtgattctgtcaggaaaaaggttgattgtgttaaaaa

SEQ ID NO: 6523 - DNA, 556 bp, Homo sapiens
agctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacaggccgttgatgctcactgccatcagctgcatcctccctatggcactggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggtgagtct

SEQ ID NO: 6524 - DNA, 819 bp, Homo sapiens
gttagtgtgtcctataaatgcacacagttggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcaca

SEQ ID NO: 6525 - DNA, 2175 bp, Homo sapiens
ggagctgggatcatgtcagcctcattcactgcatttatatgttggctgaatgcattggaaactgcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactg

SEQ ID NO: 6526 - DNA, 2382 bp, Homo sapiens
aaatcagttgtcttagtttaagctactataacaaggtactgtagactgatggcttataagcaacagaaacttatttctcagttctgtagtctggaggtccaagatcaaggtgacactgtggtcaggttctgatgagggccctcttctgggttataaactacggacttcttgtatccttacatggcagaaagagcgacagagctctctgtagtcccttttataagctcactaatcccattcatgagggccctaccctcatgacccaattacctcccaaatgcccctcctccaaacaccaccactttgggggttaagatttcaacagatgaattttgaagggacacaaacattcagtccatagcatcacttatcaagctagtatttaatacctcttaggccccgtggaagggaaaatagataggaacctgccctgaaagatgcttcagttggggagaaaaggtgaaattccattgttagacaatttgtttaagacaatacatcttgcttgagaaggaatagaagggaaatgaaatggggggagggagtggtaggagatggaggctttgaaagaaaataaccagatttagaaacatgggtatagaaagcatcctccagtacttctgtaacaatttatcaagacctacaggaagtcagttttggatttgctcctccgagatttgcgagccagaggaaaatacttagactatcaggttggaaagttcacacttggaccaggaaaagaccaagcagttgctatagtctcctggattgtgactaatctggaggaagcaagtccctgtatccttggcaaagcttgaaaggcaggcaaatgtcttctctgtgttttctgacaggtggttgggtggtgggggttggtctctgtacctcctgttctttaccttgcttaccaagcccttccaccgactcactcctgcctccccagctaaaaattggctgtgttgcttttaccacagttaccaaggtctgagttttataaaatccaggatcacatctgacctcacctggtagatatctaggccaataaagtctaaagggctaaaaagaaggtacctctccatcctgtctcctcgaggccaggcagcacatgtgcagttaagaggcctcctggatccattgtcctcctgttgcttttcgttctaagtgatccaaactctattgctgatagggaataaaagcagggcaggctagtagtgggcaagtgctttgatggagcgtatctccaagcagggcccaagtttaggaggaggaagacctgatacaatgaatgaacagtgcgtcctcccaacccaaccaagaagtgtaattgtgttccgtctttaaccctggcatggaatggggagggaagaggcatggacatttattacatagtgcacattatctacattctctgcatgtgacccagatgtcagcccttccgcttcctgcgaaggttacctctaatgcacgttgccccaggccctgctgagctagttcctcaccgcagctacttaactcaccatgaattcctagaaccctcagcctctgagagtgctgggatctggcgggagaacaggcagtacttccctcactaacctacccgcacgccataccatcattgtgcaaagctgcctcatgctggaaggtctggtttacgtaaaagtgacaagttggaattgagcgtccgactctcgggtacctgccccaggcatttctcatcagccccatttcccacacagctctctcctaggcgcagccctccttcaccaccaccacccccaccccaatcacctttaggtattttctcccctaaagcctcacctgttggcattttacatctttttaagaccttattttgtattttaaatgtatgagaaaaattatggaggatgatgcaagatgagtgagtccataatggtaataattggacactaaaaacaatgaaaacttgtctcaagtatttgtgttgaaatctcaattaactgggcgactgctcccgttccattttattctgtaaaatatgtggcatcctttgtgttgaggcggcatttactaaacacccccaaggtgcaaggctgcaagagaatcgagcgccgcaaggcgagcttatcttccacacctggtacagtgcccaggacagagaaggtgtttagcaagtttctgctgaatggaagagtgagcgagaagggaaagtgcatctaaaaagcacagggaacctacaaaatatttgggaaagggtttcatcagttcgggtgaaatcttgaacgtgcaaagcaccatgggggtggctggacaggcttgttggagtcgtataatgcaatgaataaaaacttacggctgccttaaatgcaaatgtcaagcccttaaataaaatttaacaaagtc

SEQ ID NO: 6527 - DNA, 1331 bp, Homo sapiens
gttacttgttattggtaaatagccactatggagactaaggaccagaagaaacacagaaagaaaaacggtggacccaaagctgcaaagaaaaagaagtggcatctgcaggatctccagctaggagactaagaaaatgcccagaagagaaatgccaatgcttttgcagttcagtctgctgtgtggatgtctcgatcctttcacaggactctggatttgaagacacaaaagcatcatattccagtggttgatggaactccactagagccgccaccaataccggtagtggtgacggggcctccaaagttggaaagagcactttgatataatgcctcattcggaacttcacctggcagaagttcaccgagatcagaggccctgtgacgatcgtgtcaggtaaaaagcgcagactcaccattattgaatgtgggtgtgacattaacatgatgattgatctggctaaagtagcagatctggtactgatgcttatagatgccagctttgggtttgaaatggaaatgtttgagtttctaaacatctgtcaagcacatggctttcctaaaattctgggagttctcacccacctcgactccttcaagcataacaagcaactgaagaagacaaagaagcgattaaaacacaggttctggacagaagtttaccaggttgccaaactgttctacctttctggaatggtgcatggagaatatcaaaaccaagaaatccacaatctgggccattttattacagttatgaagtttaggcctctcatggcaaacttttcacccttatatcctggcagacaggatggaagatttgacaaacccggaggatatccaaacaaacatcaaatgtgaccggcaggtgtcactttatggttatttaagaggagcacacttcaaagataaaagccaaattcacatgccaggggtagaacattttgccatgagtgacatcggtttcctcccagacccttgtgttcttcctgaataacaaaagaagtgctgtttaaataagaaggagcagctggtttatgtgcctgtttctggagttgagggtgtgctgtatgacaaagacgctgtctgtgttgaccttggtggcagccacggttttcaggacaaggtggggctcacccatgagctggtccagagtctcatctccacctactccaccattgatgccaagatggcttcaagtcgagtgacgctgctttccaattccaaaccacttgggtcagaggctatagataatcaagggctgttgatgccaaaggaggaaaaacaaatagacttgaaaactggtcgaatgcgtcagaaagccatttttggagatga

SEQ ID NO: 6528 - DNA, 637 bp, Homo sapiens
agtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaaggtatcttctttaatccaggctgctctcatcctgcatgggtggaactgaatggaggtggcagggaggtctgtgtagctgtgtttagagacgagaccctgaagccagatgtagccacgtgtctcccagggatcttatgttcaacatgaaaagcccagactcaggataaaggactgtcaccacgagaacttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaaatggatg

SEQ ID NO: 6529 - DNA, 2767 bp, Homo sapiens
ggtcatcgtgacaggcatgcctcacaccaagacggactatcaagacctgagccgacctgacttacataaatgacaaacactagtgctttacaaaggtggctggagttctccatcttctaaaatcaacatccaatccccttcagtcagcatcttcagtattcccttgaggactggaaaaccaaagcagctacgtccatctgtaacgcacccgcaccggacaggcacgagatgtcacgtccacctggcaccatccaaagagggtaaattggagaaatcacacctttcaaatgttaatctgacactgtaaacagcagttgagttctcatttacatgggcaaagaaagcactttaaactattttcacaactttcctacggaagaaaaggaaacgattcagacggttaatggctaagttttaaacaaatgctctgcatcactacttggttaagaaataatacaatttttgcccttgtgtccctttttcttcttggattttgttgtcctctgaccaaactgaggggtgggaagtgcagatggtggactagaaaggtcatctgtatagtaggcaaatctctgtggccggggttgagggattggttgtccaagaaaatatccttcttcttccgagtcggaagaggaggaggaggaagaacaccaggaatcatcatcctcgccgtagagtcccagaaaccgattcattcctgggttctgcaggccataatcggaagtggcatgggcgtactgtccgtagagatcagcattctggatgtatgcttggatctcccgggcacttttattctgtataaatttctcatagttatcgggggtgtacagccgcagtctgtccttgggagagtattttctttctgtaacaagattcagggcattgtcggagcgggactttctacttctccggcggcggtggtgatgagacctggatcccctctcttcaaaattgtagacgcgtctccgagtcctttcactcatcggaggctgccggatttcaatgtcatagttcccattgtcaatgacatcatcagaaaacttgacctgctggggtctggattgagacttggaccttctgagcactggcagatgtactggcttctcttcaggcaggattttctctggacacaactctgaacttagactctttaaggactctgcactcctgtgcagcatggaagagttcaaagttcccatattgctcatcttctcacaatcttctgtttccatctcctcaaaattttgcagagaatacaatgatggccttggcttgttttctccatccaccgaagcccctagaagagaggccaaaacaagatgtgcttctcaatcatcctaatattcgacagtacttaaaaatatccagtgctcactggctcgaatatccatctcattgggctgtggctgaaagaggcttttatcaccaaacttgaggaggagctgcgtcatataatcttcatgatcagcccattcttcagggtcttctggagtttcctgctctactctgcctttccaaaattcttcactggcaaaacttgttccttgtctggagagactcagatcatccaattttcgagaaagggtgtcatcagcattgcctgagaggccaggaaacttgtagttcagagcaggcgataagaggagagactgtctacactgatctgctgaccggctgctcttgcccattcggacacttcttcgggagtctcttgatcgagctgactgaaatgcagagtcggaagaatcagaggcatggacgtcttcaccaagactgcacgtttttgagcagtaaatctgaccctgtttgggaaggaagggacatcccaacaaagaggctttacactgggcacaagaaaagcaggcttccgtggcgtgccagtgctgcccgtcataggtcatctgtgcatggtccacacctgttttgaaaaggatagaataaataacaggttatggtttaatgcctgaaacaaggtataaggaagaaacgaagaaaataaataaagattatgggtatgggggagctgtgtgggtgacacagatataattaatcctcattctttgtggattctgtatttgtgagtgtgcctactcataaaaatttattcacaactcccaaactaatattcgcaacagtttcatggtcattcgcagatgtgcagagtggtaaaaatacgaactgaaccaacatgcactgatccaggagatgctcagctttttgtttcagctctcatactgtagacaagtgtcctatttctggtctatctactgccgcgttttctgcatttttgtgctctttgttggtgagtttactgtttaaaatggcccccaagtgtaatgctgataatgctgaaatgctgtcatgttgctaagggcaagaaggctgtgatgtgccttacagagaaaagacatgtattacgtaagctcctaatcttgagtacggtaccactggctgtgagttcaatattaatgcatcaacaatgtacattcaataaggcagtggctttaagcaaaaacacacgtgaaacaaggttatgtattgatgggttgatgaaactgctgtgaccagaggctcacaggaacctaaccctgtattcccccatgagcaatggttcagtgttcactaatccagtgtttgcagtaacgtcacagaacacaactactgcaagtaacaagaatcaactctctgttcatttgtcaaagctcatcagctggaacatttaagatctgtacatttcattgtatgtaaattatatctcaacttt

SEQ ID NO: 6530 - DNA, 572 bp, Homo sapiens
aggcagctccggggtccgcggtttcacatcggaaacaaaacagcggctggtctggaaggaacctgagctacgagccgcggcggcagcggggcggcggggaagcgcatacaaatttattagcatgcagactgggagaaccacaagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactagacgagttctcgccatattggccaggctgatctcaaactcctgggctcaagtaatcctcccactttggcctcccaaaatacagagattatgggtgtgagccatcatgcccagctggctagatatttcataatgacaatagagaacggcaggagcacaacgacagacggagccttggccaccctgagccattatctaatggacgaccccagggtaact

SEQ ID NO: 6531 - DNA, 938 bp, Homo sapiens
gaagggtcgcaggcaagattactaggcgaggcttgtgcgcccgctcccgccctggccaccagtgcccacccggtcggcctggcacagccatgatcaaggcgatcctaatcttcaacaaccacgggaagccgcggctctccaagttctaccgcccctacagtgaagatacacaacagcaaatcatcagggagactttccatttggtatctaagagagatgaaaatgtttgtaatttcctagaagggggattattaattggaggatctgacaacaaactgatttatagacattacacaacgttatattttgtcttctgtgtagattcttcagaaagtgaacttggcattttagatgtcattcaagtatttgtggaaacattagacaaatgttttgaaaatgtctgtgaactggatttgattttccatgtagacaaggttcacagtattcttgcagaaatagtatggggggaatggtattggagacaaacatgaatgagattgttacacaaattgatgcacaaagtaagctggaaaaatctgagggtggcttagtgggagctccagcctgtgctgtatcagctgtaaagaatatgaatcttcctgagatcccaagaaatattaacattggtgacatcagtataaaagtgccaaacctgtcctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactatatagaagttgtgtaaaatcagtatgaaagttcaacgttgcttttcttgctcagtgattttaaagaaattgagtagtttctatgtgattttttttttttcttttctaaactgcattcgggtgcccatctacggcatgcct

SEQ ID NO: 6532 - DNA, 1471 bp, Homo sapiens
gtgtgtgctccactcctccaacctggccaaagggcagtcatcatcactggccactgctgaccacagcctttagaaactccccttgaacgtgctgggctgaccttcctctgatcacaggcaaggtgaacaaatagaagctgagggtgaaggacctacagctgtcaccttcatctcttctcaacactgccagctgtccccttggatctcccagacagacaacagggcagcctaaggttcccatcgtgagtttcaggaagggaaattcatggaggaagttcacctctggaagggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgggcagatctgtgagctggctgatgccttgagctgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctacc

SEQ ID NO: 6533 - DNA, 576 bp, Homo sapiens
tatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttggtgagtaacggcgggaaagcgagaagaaacgggactggacctacatgcaagtgattccgcttttcgtctttggcccatagggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattg

SEQ ID NO: 6534 - DNA, 3706 bp, Homo sapiens
ttgaagtcagtggctggagtagttgtgggccagaaacatcctcctcagcccaggagaagtggcagctgatgtattttaattactgggagtcaagaagttgtagggataagaaatgagttcagctgagcgatcagctggaggtcagggatggaggaaagacccagggtgtgtgagattctgaagtagagtggtgaacaggtgtgggatggatgtcagggagaggtgagggtatctggagggtttccaaacagccaggccttcaggatggccacagcaaaacttccagttctgaatggttttgtggaaagaacatggcacctggatcttggaagacatgaactgaaatttcagttcaagcattctatagccatgagacctgggggaattggggcaagttatttcacatctttgatcttcaattctctcatcttcaaaaggagactaatgatactagggttaagtgagaatttaaaaaataatgcatataatgcactacataaatagaatcttcttcctttccctttctcctacttggaaatggctgagagcaaagatgcagttcttgcatcccatgaccacagagttctaggactgcagccctgggcaagaggttccaccttggctgctggagttttctgcaacgaagaacttcagtgagtgttcagggcatgcctgcagaaccctggtccttctgtttggaccagtgctccaaatctgtaggcctttgggccgtaatttagaagctatttctaaatttttgaaggtcttctgtctagtcctgaggcctttagtctcagagaattaaattgtcttacccagggtcggtcatacagactgccaaagcctggcctggcatccaggtgcaatgttcatctgtgttaccagttcctccatgctaacctgacaatgactcacaattccttatagcacagtgttccaaagtctgagccacagaccacctgtactagtagcagccggtgggcttgataaaaatgcagattcctggctccctgacagtcccgtgctatcagattctgtaaagtttaaaagtaatgatttataaatttcccagacccgggttatacttttatatggaaacataatgcctgaatctgacagagcgctttttcatggaggaaagttgggactcttgggcagacttcctgttgctttcgtactctacaggtgttcctgaccctggaagaagaggatttatctgactcaactggagatggctcccttcccttatttattgttgcatcctgaagcttcccccatgctgggctcagtgtgaacaaacagcgcgggagaatgcaaccactgcagaggcatatgtttgagatacctggccactggaggtcatctcgtctactatattcaccgcagataaagaatgaaaagagaatacacaaccttgtgattgctagcagtgaaagctcagagttatgacataacagaattggctcatgtgactatggaggctgagatgtcccaagagctggatacccaggagaagcaaagggtacaaattgatctgacttgatttgtcagagagccagaactgcaggcaaatagacgccagagaaatcaaccaatcttttaagccagcagtaattgttcctcctgtcggctggctaaatgacttgtatctggaggagacgctcagaatgaatcagaatgcttgaggtgacagaaacacagagcattccaaagtgggctgtaacagaagtggttgatcatactgtaaaactcaaatgtgaagggaaggctggaacctactggaaactgaagatctaacgaaaagaaggaacttttaggaactagcagagacttcaaaatgttgagaactctcttttttcataagagaagataaaaactctgatggtcacactcataaagacaaaaaacaaataaaaaacaaacaaaaactcagaatcacaagagcaaagaaaatgtaggtaaaacaataacagaagaggtaaagaaatttatgtgaattgggacactctggggcacagaacagaagaggagaagaaacatgaaagtaatgctctgcacaaggatgtctgactgtccttgattccaagggcatttaaaattagccactggatgagaaccatgaaatgccatgactcttacagctcccatgaaagacattggatggaacttatcctaactggaccaaattctaaaaaattttacatgatattataatgagttgaaagttgaaaaaaaaaagctcttctagattaccaagaataaaacacaaatttctagctgactgaattaattctcatctctctatagaaagatcatagaaattttttttatcatgcaaagaaatagctaaaaatttacaaaaatatagacgtgcattaggcagctcatgaataaatgcgttttttccttttttcctccagaattttgtgatgtttatggtacttttcggcttttaaaattttgtatttaatcaggatttattacttcattgtaagtaaatattaaatttgtactccatctttgtttgtaattttgtatatttttcagtaaaaaggactccccagattatgtaagctttaggccccacaaaatctaggcctgttgctgtatcctttctagagcagtgtttctcaaacttcaatgtgcatttgaatctcctggggctcctgttaaaatatagcttctgagatgatgcatttctaacagactcccagggctgacactgcccatctggggaccacactttgagaatcaaatatctagaacaatggttcttacctggctgtgcattgggatcatttatagtgcttttggaaaatacattgtgtccaggtcccacccagttctcagtaggcttggaatggggtcctacactttttttttttaactccacagtttgggaaagaagccttttcatatattgttggtgggaatacaaattgatacagccatttttgagcttgatttggcaatatcttccttggagaaatcaaaagccagttggcaagccagtctggaaaaggcagtttactgattcccacccgagggtcacaaagcaggtatagaaggatgggctttggctgaaatatatgatgggtacaggtatattctctataatccagtatttccactgctgaaaacgtatcctagtaacattatacatatcaagcctacatataaagttggtcaattccatattatttgtagtaggggaaaactgaaagcagtctacatgcccatcaatagattattcaaattatggaacagttttccaatgacaaaacaatagctaatcttagttaagcaattattatgttatgtaaggtagacattgttctaccttatttataagtattaagttagtttttataactatcatatttccattttacaaatgacataatttatattattgacatgggaagatgtccaaggatataataagcaaaaagcaagtagcaaaacattatgtatattatgcattaccattataatatactaaaaagtaatgcacttgattctgatgcacactccccagtaggtaacaacttatctagtgtaaaaatgaaagaacattctgggccgggcacggtggctcatgcctgtaatcccagcactttgggaggcccaggtgggcggatcacaaggtcaggagatcgagaccatcctggctaacatggtgaaaccccgtctctactaaaaatac

SEQ ID NO: 6535 - DNA, 625 bp, Homo sapiens
cagttaatttttgtattttttatagagaacaggatttgccatgttgcccaggctggtctggaattttgagctctagagatccaccccctcttcacctcccaaaatgctgggattacaggcatgtgccactgcgcctggcttggtttatttttttctattatgtggagagagatgggaatttaaccaactatcaataaaaatccttgtgtctgagtaggacacatatttaccacctgatcctttatccaagttagtatttctctgtgaacttaaccctgataaagggagttgaaacagaggcagttttactggaaataattatttttcttttttttctctccttttaggaaaacgaaaaagaacaaacagaaaacacctggaaatggagatggtggcagtaccagtgagacccctcagcctcctcggaagaaaagggcccgggtagatcctactgttgaaaatgaggaaacattcatgaacagagttgaagttaaagtaaagattcctgaagagctaaaaccgtggcttgttgatgactgggacttaattaccaggcaaaaacagctcttttatcttcctgccaagaagaatgtggattccattcttgaggattatgcaaattaca

SEQ ID NO: 6536 - DNA, 563 bp, Homo sapiens
atgtaacactgtgagagtaagtggagactgagctgtgtagctccgtctcttctgttgaaactcttcaggatggatttagtgcgtgttagggctcagggaggacaggttgagggttaagcatcccaagcatatgtttatttctggctgagtatttacagggcttaaagcctatgcattttgtctttccgcctaggacaacaaaagtaaaaccagcatgggttttggctctcactgttgtttttgccctctgtaaggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctact

SEQ ID NO: 6537 - DNA, 2325 bp, Homo sapiens
ctctatccccagcagaggcagcggagaagacaaggccgggaggcaccgggctaggctgcgcaccaggcccaggcctgtccctcgggaccgcgcgtgccgcctgaatccgctcccccgtcgggcccggtccagctggcgcggcggccaccctcacctggatgacctcgttgacctcccggatacattccaccatgtgttgtagaatctgctcggccgtgagcacctcgtagcggtaatcctcctcctgctcatgccccggcccgccaccaccaccgccgccgccgccgccgccgccaccgccgggccccagagcgctgccgccgccaccgcccgtctccccgcacagcagtccgtcccgctccccgccgacgcccagcccgggctccaccagctccacctcgcccagatccagggtatcatcgtccggctcgtcgtcgtcttcgtcctcctcctcctcggcgccgctgtcctcctcactgcactcctcgtcctcgtcgaactcgtagttgtagccctcgtccgagtccatggcgcgacgcgcgggggcccggcggacgctggccgaggcggggagagggcggggacgccgaggccccggctctcgctccggctccggctgatgtccggacgcaggcctggctccggccccgcgagccgcggctcctccccaggagcggcggttggcgtttgacggctggtggcggcggggagggcgcggaggagggagggagggagcgagggggccgcttgctgcccgcctcagtcagacgcggctccgctccggcctccgagagaaaacagtccccaacgccacctccacggccgctgctatcgctactgagccaacaaaggggcgtgcgtcaccgcgtcgcgctgcgtcgtcgcgtcactcctctttgcgtcactgcgccccgccccaccgcccctgcgtggagcccggggagaccccacggcccggccttcctgggcctgggacccgaggggagccgagcgggaattgctttcctggttcgatccgctgccgctgtgagggccgagcggaaacccgtagaccttttatgtgaagagattgcggcctcctggtcaccagtcaccgagagagggacccctggaccgcctacgtggtggtgtctgccgcaggccatagggatccagcccacttaggcagtcccttggggacgcggccttccctccggagcggaaaggcgcttcccgcccgccctgcggtaatcccggaagccctcagccgttaagctaaaatttctgttgctttggctactgatggaaacctgttgtaagtggaacctctaaactgtatgacaggtgaacccactttaggtagctgtgtgattctgtccacttgtacagacgtgcagtggtttttaagtctcctataatgacgtcattttaaagaggcatttcctccaccccgctgacaagagcgcctcttgagggccctaaacaatgtaaacagcgatgattttcatgaattgagcactgtgtaagggctttacatatattctgtctcatcttcacggagccatagtacccattttatacctgaggaacctgaagctcagaaaggaaaagggacctggccaagaccacataacccttgccctattttaaccgctggatgccccaaaacatgaatcataaaaatgctttgtaatgtagatatattatgtactatgtagtacataaaagacatgaatgcttcaacaaaatacaggcaataatagaaatatctacaagggccaaatgtagccagagagataatgcttgaatctcatctgaaagtgtgctatgtgagctgagtgttgatgaatggctaggagttcaacagagaaggtagggaagatggtctagccgcagagaacaagcaaaagcgcagaaggtgtcaagtaagtaatagtttggggagcttaaagtgcatggagggtacatggcaaaatattaggcaagttagtcaggggtcatgtcagttaagagcattttatgcctaagagtgggcttaaatctttgcaaacaggacatgcgagccagagaagtgttatgaaggaagaagaggcataagaaggctccctcttgagataatctgaagaattggccagattgaaaaccttttaaaatcaaaacccctgatttgttgataaatcttactgttcaacctataggttccctttggaaattgattttgaaaagtgaaaaattccattataatgttaaaaagcctcttccaatttgtccattttgtaagttttaaaataccgataattatatttcttaacctcaggatttacaaagtaaagcatttaacctcaa

SEQ ID NO: 6538 - DNA, 566 bp, Homo sapiens
ctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagaggtaaggaatacagagtttgttaaaggaaacatgctgcagacatgatttttttaaaatctcttgctggttcagattttctttctgtttttaaggaaaagcactacctgtgttgcctcttgtaaagagttaaaattgcctacctgcctcctagcatagtctgggagtaacaaatgagatactaggtttcagtgttcttgtactctagaacagtgcaccaatgcaagttgatacagttgttcaagcaa

SEQ ID NO: 6539 - DNA, 713 bp, Homo sapiens
ggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtacttataataagtgtctatctatctctctttttttttggcctatgtaagtatatttttccattatttaatcttgtgttccaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatga

SEQ ID NO: 6540 - DNA, 947 bp, Homo sapiens
acaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggtaaagtgaaatcgtccatttatagtcataccaaaagcataatgatcttaaaatatatttgaatgtttgctgaacttctagttttagtcattatcagacttacttgatgacattttaatacactttaaaaaatttcctcagattattaaaggatgaaaggcctaaaattgagttcttttccaaatcacgttcccatttcttcatcagttgtaaaatatttgtgttttcttgtagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacaaaaattagctgggcctggtagcacgtgcctgtagtcccagctacttgggaggctgaggcaggagaatcacttgaacctgggaggcggaggttgcagtaagctgagaccacgccactgcactccaacctggcaacagagtgagactccatttcaaaaaagaaaaaaaaaaaaaagaaataagaatcactaactgctcttatagaaattatgatattcaagtaaaataatgaaaataaagcactttagttttcaaattattagtattttttctctgtagatagtcttcatctaattttaaaattgcaatgataatataatagtttgagtatttgtatacatgatgaatttgagtatatatgatgaatattcatgtactttttatagaatctatttattagagatccca

SEQ ID NO: 6541 - DNA, 649 bp, Homo sapiens
agttaacttacatgaggctcaggttccttacctgtgtgtaaaatgggaacattgaactaggtgatctttaagatcccttccggctctaaaattgtttgacattatcttggtggtcagtaactgtgagaaacacattcctgaggaaaatttgcagctatagttgacttcaggacagcatgtttagggagtagaatgtaagctccctgagggtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggac

SEQ ID NO: 6542 - DNA, 1176 bp, Homo sapiens
agagaggccagatcgtgtggacttggccttttcctctgggtctgatgggagcctctggaggattttgagagaggaaggacaagtccgtctttagtttgtttttttttttttcttgagatggagtttcgctctcgttgcccaggctggagtacaatggctcgatctcggctcactgcaacctccacctcctgggttcaggcaattctcctgcctcagcctcctgagtagctgggattacaagcacacgccaccatacccggctaatttttgtatttttagtagagacagggtttcactgtgttggtcaggctggtctcaaactcctgacctcaggtaatccacctgccccggcctcccaaagtgctgggattacaggcatgagccactacgcctggccctgtcttaagttttaacaggatccctccagctgcctgagaatacacagaaataggatgaaggtagaagcagtaagacataagaggttgtggtgctcttccggatgagaagtgcttagattctggatacattttgaagagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaac

SEQ ID NO: 6543 - DNA, 670 bp, Homo sapiens
cctgtctttagggctgacctttcgtcctttgacctcctcagcctccattcccatcttcgctcagactgcaagtatgtttgtattaatgtactatgtaggcggcttggagctggggaacattctttcattctaagaatttgcagatgctgacgttcctcctttctgcccctacaggctctggcttatccaagaggcaaacactgacctctggtaattaaaatcctagttcttttcttttgtcttttccaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 6544 - DNA, 804 bp, Homo sapiens
gaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggtaagttttaatatcttagcggttttctttttttaagctctgataatcatttgaacttgtacattgcagtttaataatttttaaaaatgacttgagaggataatactaattttattttaaaaaacaaaaactaccattcccattgtaggtaaagttttgtaagaaaattttgggcatcttggtgatagtagttatgtaaacaaatacatgtttttgttttttcgaagaagtctccttccaaaggtttatgtgatttttgggaatatcctcaggttaactgtgctctgaagaaaggaaagaacggtagctcttcctccagttgatgtcagaagagaatactcgctggagtattaggccctagtgagagattggcagggatttgtgagccaaggtttgaatggtgactggagcaataaagttgggaaagagtttgagcttttcc

SEQ ID NO: 6545 - DNA, 726 bp, Homo sapiens
gcaaaagtatcgggggcgggactcgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatcatct

SEQ ID NO: 6546 - DNA, 4063 bp, Homo sapiens
aagtaagcaaaatgttttcatctttcaacagcatgacccatctgcctggcaccagcacctggggctgccaggcagccacccctgcagctgtgttgacaggacctggcagagggactgacccacctttggaaaatgacaccagcaatatcaggatgtgtcaactggatttatgctaagaaaataggatttttggtgttcctctgtttcccaaagtttgagacactttcagacactctgctttgcggttgtggccgatgttacccatgggtgggacttttgctttgctctagatttttgtaacaccctggggagtttcaggggccaatgctgagagaagaccacaggctgacacatcatgaggtatgttggtaaaacagtcccggctggccgagaggccactgagggaacaggcccagggtttggtttgtactctgtgagtcttggcctggcagggtttcctgcaaagcagagtcctctgagtgggaccccaggggaagcaggttgttgcctggagctgaggggcagctctgtattcaggaggggtgcctgccttcccatctcccctgtgaccagatgtcacagaaacattctctctttactccctagaccctctgggcaggtccactaagagcatgtattctagaacatgcagggcttgaagcttcacaagatattcagtgcactccttacagatcctgtcaaatgtggaccgggtggtgtcatcgcaccaccatcatccccttgttacccctgagaacacagcttcagagagggtaagtaacctatctcaggccacacagccaggacatggagtagatccatcctaagtctttctaccacacactcctttctacagtcatgggttaaatgagggtgccatggaatgggtcatccagtgtacactgacatcaggaggagtttcacattcatacactcatggcaaatggttctgttgctccctggtccaaagatgatcttaatagtaggaaaaactcatttggcagaagcaagactcagcacacaggctctctccctgagtcttctgtggctggccttgccctgccctcccctccccaaccccactggcagaataaagtcggggggctgtgaggactgagccccaggccttgacaggcacccgcagccagccgaactcccacctgcccagttggaggggtgcgagaaggccttgctgctctgcaccaccttcatggcctcccccagggcggcgctggctttcaggccgttcagcagggatgagtagaaggcatggatgaacatcttagaagcagccactggcacaggccacagagacacgaggacacactgagcgccggcagccaggaaggcccttgtcagcgcgatgaccccgtcggctgtgactttgctgttggactcctgggaggagccaagcaccaccagcttcacaggcagctgcaggtccaggacgtcggcggcagtgcctaacttactgagaatcatgcctgctgtgatgagcccttggaaaccatcaggactggatggtaggggtcctgagaggattgggggaggaggccttgatatgacagagtggacagaggccgtggaacccaggacagccagcctgctccacaatcctcatccccacagaccttcatgtgtggctcctaaataagaggaaacccactcctgataagtcaggggctttgaaaagtgattttgtttaaatggtgcaaacaagcaagccaatcttggggagacagggctaaacttaagtcctttaagaagctctacatactgacaagattctagttcccttccaccttatatgctgcaaagtaaaaagtatcactgaatgagaaaatcagcataaagaagcccaataatgtctgcctgagtttcccctatgatgacttttggtactttttgggaaacattaagtatgaagttatttcaaaataattttttggtgcctctgcttggtgatgccttaaactctgggtaagagaaacaccaggtgcctgtcaggagatggccttttccaggtttctggttaagctacaaacagctaactggctgctgtcatcaaaataaaagctttctgaaggtggaggcatctgatacccagagtgctgctatcagccggcacggtgggccgctgggtggcaggagcgtcgagaaggccagctcgcttcctatctgggattcagaatcagctatggaaacttgagagacctagagaaaataacttctttcactttgaactgattctttgcttcataagaaaagtattatccagccacaaaaatggtcaaaattcagatctacaaaagcctgtcaggcagaaactgaccccacttaggccacgccaatgagcaagtcatcaaagcagccaagacaggtcctgtgggggccacccatgcacagggcccagcctcgggtcctaaccccgcctatgctttccgccaccataaagaggcccatctgggtaagacctgtcccgcctgctgtggggtattagggcagatggggtctgaggggtctgagggctctgagagcagctggcagctcaaggacatccggagttggaggatggagcaatgcaggcccttgtggtaaagacagtcctgcagccgcgcaggcagggatgctgcaagtggagtgccaggcgggtgcggagccctgtgggactgtggaggggtcagagggaagccaggattttggggtctctgagagtttggagaaggggaagaagattaaagcttgtttcaaaagtttctaatcaggtgggcagggccaagggtggctgtggggtgagacccatgactcagggtggcccactgttactctattgatttttgggcgtttttttccaaattgattattcttgctgaatgagacctgagtccttgactgtccccttaaagccacctgacttgttttcagttccactggcctgtcgggctgttttctactcaactccactcttgcttgtctgccctccctgcctggggcccagccagcagtcagctcaagggccagatgaattgggtggctgtgctctgcccactgggcatcgtgtggatggtgggtgaccagccccctcaggtgctcagccaggcctcaagccttgctgtgtacctcagagcagctccgtaccctgatgtcacagcaaagaaacttagacatgacacaaactgtggcttcccaaggcagcaaagaatggccaggggtcatgagggccgtgccccacttttggacagacctactctaaagtcacgctacctgcgtgcaaatcataaaatcaacacttttgaggagatcacagctatgccttcgtaacacagcccagtccgaccagatagacggtgcctcgtgacccgaaaacaagcccccggccccccaccatgtgtgtgagccttaccttggactgcacgctgagggagcggatggaagggacagcaaggaggccgaagcgctcgtagaggtactcattggaggagcttcccttcaggagggcgaaaggaatgaggtagagctccccctccagaaccaggatgagctgccggtgccggcccacggggccgctggagtgcatcaggccctatggagcaagcacggagaggctgacatgggtggcccagcaggcaggggtttcaggcaccaggacaaccctgagccctagcctggatgacacaagcacgagcagaacaaggctaagggcgcgggcatcttaatgagagcagcaggcaacaatcctggaagctgggtccacacagactgcggtgaacaaagaggtggcgtggaagctgctgctgcagcccagagcctgccaagaaggtcccaggtccacagggcctgcgcaacactgggtgccaggggtggggctggcctgccccccaaccccatctgctgaggagtggctgacaagcggacacccaccagggtgccactcgcttgtgcctggggaagcaaatgtgctcgcttgacccgtctgatgtgctgccgtgggcacttgactgagagtggcagagcactaggctaacccaaagtgacacatgcctggcgggatgttcagtctctg

SEQ ID NO: 6547 - DNA, 3590 bp, Homo sapiens; identical to SEQ ID NO: 3837

SEQ ID NO: 6548 - DNA, 593 bp, Homo sapiens
gggtattttaaccatgaaacatctgacaacaaattatgtgtctagatatgtttatgtgtgaatgttcatgtatcagggattcagtttcacagttttaacttcaattttcttgtttaccccacaaatgacaaaattgcgtcattccttctctttgcccctttccaacaccaccccacaattttttaaacaatcaaaagaaaaattaaaaccagcaaaccttaaattcttgtttgttatttggatggtgaaatactgcaggtagacactgaattggacattgatttccttttctctgcgtcgaaatgtcaaggaaagttgcaagtctgtgattttgtgtttggttttttgcatgttgcttctatggaaaaacaaaacaacaacagcagacctccctgcccaaagtgttaaaatgcctccttcataacctgagacttactttcattttctaggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggaca

SEQ ID NO: 6549 - DNA, 2948 bp, Homo sapiens
cctagtgagggtcagggaggcccggcccgcgccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagatccgagtcatataaggctgctttcttttgtgtttcctgttttaaatactgactaccaccattggcttggcagagaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtatctatcaactcatcatttttatgtatatatcaatatgattttatgatcttattttttcctactaatgtgatgaattaccttgattgattttagaatattaaatcacttttgtattcctggaataaaccctagatggatgcttgattttttctaattccttagcaaaaatgctaatattttatttaggattttgcatctatattcacaagtgaggatttttttcctctcctgacaccaaccaattctccaacacaaactgagtgtcctacaattcaatttaattctgacactacccagagttagcattagcctccacagatttaaggcctcagccctacaagactgtcccaatcagactccagttgcaagtcctgggccacccatacttctgggcaactggttacaaattgggggttcttatgaccacctcccacaggcttgacaatttgctagaatgattagtggaaagcaagaaagtgcttaacttaatattactggtttattacaaaggatacaattcaggaaaagccaaatggaagtgatgcatggagcaaggcaagggagaatgagcacagagctttcctaccctctccaggcacaccactctcccagcaccttgatgtgttcaccaacctggaagctctctgaaccccatcatttagaggttttaatggaagtttcattacataggcatgacttttttttttttttttttttttttttttttgagacggagtctcgctctgtcgcccaggctggagtgcagtggcaccatctcggctcactgcaacctccaccccccaggttcaagcaattctcctgcctcagcctcccaagtagttgggactacaggtggacaccaccatgcccagctaatttttgtatctttagtagagacggggtttcaccatgttggccaggctggtcttgaactcctgacctcaggtgatccgcctgccttggcttcccaaagtgctgggattataggcatgagccctacatagcaatgactgattgaatctttgaacactggtgattacttcaatctccagccccttgtccctctcccctccccagaagtcagtgggtggggctaaaagttccaaccctctaatcatgcctagttctcctttttttttttttagttgtttatttttcttggcatgcagaataagagctattgtctaggtctttctggtgacctcttcatcctgaactacctagaagcctccagccactagtcatttcattagtatacaaaagacactcttgccattgtggagatttcaggagtttcgggagccatgtgccaggaaccagggacaaaacccaaatatttattttttctcataccacaatgattgacattggtctgtaattttttctgcttataatatcctagtccagtttttctattaaggttatggccacataaaaagagttgggaactatactctgttttgctattctttggtagagtttgtccaagtttatgcaagattggtattattcttttttttttagagacaggttctcactctgtcacccagactggagtagcagtgatgccatcacagctcattcactataaccttgaactcctgggctcaagcaatcctcccacctaagcctcctaagtacctgggactacaggtgcacgctgccatgccctgctaatttttaaatttttggtagaggcggtgccttactgtattgtccaggctggtcttgaactcctagactcaagtgattctcctacctcagcctcccaaagtgctgggtgtataggtgtgagccaccacacacagcccatggtattattctttaaatatttggaagaattaactgatgaagcaagccatctggggcttggaattctttgtgagaagttcttgaatagattccatttatttatgagatattggctattcagattttacttttttatgtgggctttggaaagttgtatttttcagggggtttgtctattttatccaagttgtcaatattttggtgtaaagacaataatattctcttatctttgttatatttgtgggatctgtattgatattcctttctaatattgaaaatttgtcttttttgtttctgttgatcagtattgtttggagtctatcaatataaataatattttcaaataaccaaattttgatttcgttgatttttctccattgtatatgtgttttctatttcttttctttctttctttttttttttttttgagacggagcctcgctctgccgcccaggctggagtgcagtgacacgaccttggcttaccgcaagctccacctctcgggttcacgc

SEQ ID NO: 6550 - DNA, 577 bp, Homo sapiens
attccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccataacagtcttgatggaggaagcagccctatgatcaagcccaaaggagacaaacaggtgg

SEQ ID NO: 6551 - DNA, 2591 bp, Homo sapiens
cggggccctgccctgcgggtctcacctgccgctcggcggggtcccggcgggggccggacagcgccacctggcggcaggtggacgcccgcgcagcgcatgctaatgagcccgcgtcgtcgctcgcggattggctggcgcggattccagctgctttccaagttggaggcgcctagtgagggtcagggaggcccggcccgcgccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagatccgagtcatataaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtatctatcaactcatcatttttatgtatatatcaatatgattttatgatcttattttttcctactaatgtgatgaattaccttgattgattttagaatattaaatcacttttgtattcctggaataaaccctagatggatgcttgattttttctaattccttagcaaaaatgctaatattttatttaggattttgcatctatattcacaagtgaggatttttttcctctcctgacaccaaccaattctccaacacaaactgagtgtcctacaattcaatttaattctgacactacccagagttagcattagcctccacagatttaaggcctcagccctacaagactgtcccaatcagactccagttgcaagtcctgggccacccatacttctgggcaactggttacaaattgggggttcttatgaccacctcccacaggcttgacaatttgctagaatgattagtggaaagcaagaaagtgcttaacttaatattactggtttattacaaaggatacaattcaggaaaagccaaatggaagtgatgcatggagcaaggcaagggagaatgagcacagagctttcctaccctctccaggcacaccactctcccagcaccttgatgtgttcaccaacctggaagctctctgaaccccatcatttagaggttttaatggaagtttcattacataggcatgacttttttttttttttttttttttttttttttgagacggagtctcgctctgtcgcccaggctggagtgcagtggcaccatctcggctcactgcaacctccaccccccaggttcaagcaattctcctgcctcagcctcccaagtagttgggactacaggtggacaccaccatgcccagctaatttttgtatctttagtagagacggggtttcaccatgttggccaggctggtcttgaactcctgacctcaggtgatccgcctgccttggcttcccaaagtgctgggattataggcatgagccctacatagcaatgactgattgaatctttgaacactggtgattacttcaatctccagccccttgtccctctcccctccccagaagtcagtgggtggggctaaaagttccaaccctctaatcatgcctagttctcctttttttttttttagttgtttatttttcttggcatgcagaataagagctattgtctaggtctttctggtgacctcttcatcctgaactacctagaagcctccagccactagtcatttcattagtatacaaaagacactcttgccattgtggagatttcaggagtttcgggagccatgtgccaggaaccagggacaaaacccaaatatttattttttctcataccacaatgattgacattggtctgtaattttttctgcttataatatcctagtccagtttttctattaaggttatggccacataaaaagagttgggaactatactctgttttgctattctttggtagagtttgtccaagtttatgcaagattggtattattcttttttttttagagacaggttctcactctgtcacccagactggagtagcagtgatgccatcacagctcattcactataaccttgaactcctgggctcaagcaatcctcccacctaagcctcctaagtacctgggactacaggtgcacgctgccatgccctgctaatttttaaatttttggtagaggcggtgccttactgtattgtccaggctggtcttgaactcctagactcaagtgattctcctacctcagcctcccaaagtgctgggtgtataggtgtgagccaccacacacagcccatggtattattctttaaatatttggaagaattaactgatgaagcaagcc

SEQ ID NO: 6552 - DNA, 1529 bp, Homo sapiens
agctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcagataaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaaatcacaaa

SEQ ID NO: 6553 - DNA, 781 bp, Homo sapiens
ggagtggaaaagtctttggagaagtttttgggggcctggctggcacatgggatccactctgctctccaggaagcgtatgccatcttctagttcgcatttctgcaccaaggcagtggcaggtggcccgaagagtgagtgggaagcaataatcagctctccaacgcttcagcatggaagggatctcaaatgtcattcagaatggcctccgccacacctttggaaattcaggtggagagaaacagtatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactat

SEQ ID NO: 6554 - DNA, 1510 bp, Homo sapiens
cggaggcgggttctggacagacctacgctgtccgggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagaagatgaagaaacccagcttgatatgttgaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggaatctggtgaacagtaacaaactttggtgaaatttcaggaaccatagccattgaagtggatgagggaacctatatacatgcactcaacaatggtctttttaccctgggagctccacacaaagaagaatcgccctgaaacctggctatggaaaataccttagtataaattcagatgaacttgttgttggcgttcagatgcaattggaccaagagaacaatgggaaccagtctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaat

SEQ ID NO: 6555 - DNA, 2755 bp, Homo sapiens
aaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatcttgtcagcttagtgctttaagtgattgcatttaaaaaaattctgcattttcagtttttagcaggaggaatggcctcaactagtggttttcaactggggatgatttttttcccctaggggacatttgataatgtttggagatgttttagttgttagaactggggttgggggaactactgtcatctggtggggagagaccggcaatgctgttgatcttactataatgcacaggccacccccaacaacaaacaaattacatagccccaaatatcaataatgccaaggtccaaataacctaaccttccattactgaaaatagaagttcaagaagatagtttataatttaaaaatttttaggtcttaataagttgtcatactttcacaggttttatttcatactaagtaatttatttcaaattttacattccaattacagaaaattttctaagccagtttttgttcttcatgagtattactatcaaggtcacatttttcatctagtatgttttaccctggtacttgttggcagggtcaggactaaggtgagatgcgcaaggcatttgcctcacacaaaatgcacaatgaataaaatgtcaaaactttaaataaagacagaatcactaaaagtactttgccatattggaacctgaggcaaaaagaaaaataagtaataatatttaaaattttgatctcttgttcattgtagatttttacattaattttgattgtttaaaacattgcattaaaatattatttaatgtg

SEQ ID NO: 6556 - DNA, 643 bp, Homo sapiens
cccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaa

SEQ ID NO: 6557 - DNA, 421 bp, Homo sapiens
tagtcaataccggttttgtcagctcatgatagaaaatcttcccaaactccgtgaggatattaaagaaatctccatgtctgatctcaaagactttttggaaagtattcgaaaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagaggtgataggtgtctttctttcttttctattattagataattttttttcttttggattgtaatgtacatctgtgtgatttagtcttcctgtatgcaaaataaatttatgttgtaaaagt

SEQ ID NO: 6558 - DNA, 469 bp, Homo sapiens
ggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatgg

SEQ ID NO: 6559 - DNA, 1124 bp, Homo sapiens
ccggccgcctgcgggggacgcaggaagtggctccccccacacccctcacccctacctcacacacgggtgagtgcccccctcccagcgctctggggctggctctggggtgacttcttgtgtcttggggttggtggggacaacagggtacttggtggtggacactaagtgccctgtgtcaggcgatgctcgctcctgagggtggatgagccaggctgcccaggcgcctttagaaatgccggcacctgctggtgtgcgtgattcctcccgcatctcacgttcctcccctgtgagccccttgacctcgctcccatgtccctttgtgtccctccggccggatctgagtgttggtggccatcggccacagccaggtcctgactgtccaggcagcccagggtcctctctggccacagcctctcatagaaagccccgagtgagaggcagcagacgggggcggcccactccgtttctctccctgtcctcagctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgcta

SEQ ID NO: 6560 - DNA, 855 bp, Homo sapiens
ttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccgtcagataccaaggctttctaaagtcaaccttttcactctgctcagcctctggatggagctctttccagcagaagcccagcggcaaaaatctcagaaaatgaagagggaaagcatggacccttaggagataatgaagagaggaccagagtatctactgacaaaagacagtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgtggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataa

SEQ ID NO: 6561 - DNA, 555 bp, Homo sapiens
ccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcatttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacaggg

SEQ ID NO: 6562 - DNA, 522 bp, Homo sapiens
tttataaaagcagggagctggagcatcacacccttgtaccgccagtcctcatgtttatgccataccatcaaggctcatacagcagatgctgtagcccatggtggtgtgagctgccaggttgtgctgcacggctagctcatggagtctcaagactacttttttttttttataggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggag

SEQ ID NO: 6563 - DNA, 2849 bp, Homo sapiens
ttgagtttttgtaatatttaattttttttctggttcttgaaaaacctataattttacttatgtcattcccacttcaagttctttttggaacaaaatataaaagtgacttatttgagggtgattcaggaatattaatggtgttacttagcttgtataggtgtttaacctggaagtcctagttctgtgtaaaagatactccataataagtgtttaaaagcaaaccacttcatgatttcgtatcttttaagttgctcttacagtggcctgataatcaataaaacacagtggggtctcccattctgctttacctggagggagacagcaggtcttgtatacgttttcactgtgcctgaaaagaaagcttaccattgttcaggtataaaggaacagctaataaagctgtgttgcaggtggctttatgacctatgctatctttttcatctttctaagcaacttaatccatattcgagtaggataatgtgtacaggcatagtttgtgggcagttatacttgtgcttgaacacatggatagaaggaccctggaaaggccatgtactgattggaaacttttcttttgacctggtttgagtgttgcctccagtctggtgggttttttgtgcatttttttgttgtttaattccccaaggcatacaacatccaataaagagttgacagcagtttaacgtatctttgtggtgtataagtatgttcttcagtggatatgtcctttctccatatactatgtgtaaatttaattggtaattttgcaggtgatgctttatataattatatctatgtaatatctctaattgcagctgaagcgatttgaggtctatcatagcgttgatactttgagtcatattttttcccctttagattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttgggtatgatttcctttatcactctaaaagttaagtgtaattgttttccatctttgtactaactctgattcttgaatctttcttagtaattctatattaccatgagaggaatattcatgtattatttttggaggacaatagggatggctgttagtacctttagggactgcctagtgagttttgatattgggagagctcttgttgcctctgttgctgtaacaaactgcagttgtgccaagacttgcaggccctatgacaatctgtgacagattctttttgatataaatgcctcgaaagtcattagagtggtttgcctttttgtacccctaaaaagagaagagttcttggctttaaaaagaagccagtaattgagactgtatctatcatactctgttagttactagtttgttattaataaccagtagttttattaatggttattatcactcctattacttgatatgtattattttaaattttgtattatactcgttaggacataactttgtatttctaggcattacttggcactgtgccttgttgagtcagatgtttgctctatcaatgaaaggattttccttggtgcccatcaggagggtttagtggatagattctaacaaattagctgtagcatcagcctcatctactgcctctgctgaatgctactgcaattaattactcttttctaactgtatgtttacgtaaaatagaactacagtataattctaagactgcatacctggattttttttcatctgtctagcagattctttaacacgtagattcagagatgatggtgatttttttttctcttcatcttgttaaagcttggttccagtgtcagaagcaagcataatcattgctgtgtcctcagcccacagagctgcatctcttgaagctgtgagctatgccattgatactttaaaagccaaggtgcccatatggaaaaaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagttt

SEQ ID NO: 6564 - DNA, 546 bp, Homo sapiens
ggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaaca

SEQ ID NO: 6565 - DNA, 1558 bp, Homo sapiens
caagcttttcatatgtattgtattatcattcctcgtgttttagctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaa

SEQ ID NO: 6566 - DNA, 883 bp, Homo sapiens
gaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaag

SEQ ID NO: 6567 - DNA, 350 bp, Homo sapiens
tcattttgtttttcatatgtgtgagtatattcaactttactttttcagacaacaaattaattgtggtgtgtccttttgatttcagaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatctt

SEQ ID NO: 6568 - DNA, 478 bp, Homo sapiens
aatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggttagtatatagtctcttgagcatttccttgtgtgtaaactacaagcctttttgtagttagccaaagagaaagaaattatccccaagaaaatcacctaacagataactctatggtaagaatcttaccttattgatgtttgttatcttgc

SEQ ID NO: 6569 - DNA, 722 bp, Homo sapiens
ccactgcttctaaatcaataaaacagtggatgactgttaggaaaaacaaagccacgcttctttaatatctactgatctatgctaaatctgctgcacagatactacccagtgttgaaaatgtactaattatatacctgacatcttaacagatattaaactaagttctagttgagcccaactgcagatcagagaaaagaaactctgtgcttacaatcagtcatcttaaatgcaattagttttctctggtctttcttttcaaagaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaa

SEQ ID NO: 6570 - DNA, 14547 bp, Homo sapiens; identical to SEQ ID NO: 2271

SEQ ID NO: 6571 - DNA, 574 bp, Homo sapiens
agcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacggcgaactttctgaccaagtatacaactacccagagggcctaggagaagtgctgtatagagagcagttcgacttcaacgctgagccaccttgggaacctagctgatgataggggggttccatctcccaacttgtccatctctccctgttctacttccagggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcagtttgttgcatattctaaggacccagacataggcttggtgg

SEQ ID NO: 6572 - DNA, 412 bp, Homo sapiens
cagacggttgatgatgaagcgccggccgtgtaaatgaagatcgggtgaggagcaggacgatgcccaagggtgggtgccctaaagcaccacagcaggaagagcttcccctcagcagcgacatggtggagaagcagactgggaaaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacagagcgctgggcaagagcccgtcctaggaccaggcctctgtaagggctgtgggtgcagcaaggagtgggaaggcacctgccatgtcccggccccaagacagctctgcccaccgagccctctcagaccag

SEQ ID NO: 6573 - DNA, 643 bp, Homo sapiens
gatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaat

SEQ ID NO: 6574 - DNA, 601 bp, Homo sapiens
gtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgcacattgtactgcctttaataatttgccagccgtttaatatggagagcctatcacagtaatattcacctttgtttattctttagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtg

SEQ ID NO: 6575 - DNA, 754 bp, Homo sapiens
attttgggtcatgcattctatcaacttgtagtagtctttacactcttatttgctggtaagaattcagtgtctaataaagcttcagttaattgtttcttttccaagctaatcatccaagatgttataatgttacaaattttcaagagcctaaattctactcctgacttcccatttatctttaatttcttcttaatcagtgagtgcttagtaaatttgggaggacaataagctagatagtagaataaacaggagaataaacagtcctgatgtcttaccctggctctccactaatttagatatgtgatcctgagattatcaccatagttttgggagcttctgtttccttgcctataaaacaagagagttgtactagataatcccaggtttctctagctccttccatgctgccatttcagatcaaataaaaggtctagctaagttgtaatttgtatacctccttgaaatctaatttggtatgataattacaaaatagtcatttttcattctttcaggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacct

SEQ ID NO: 6576 - DNA, 773 bp, Homo sapiens
agagtgagggagggcactccttcaaaccagtacctggaaggctcatctaaggtcttctaggcctagcattctaacatcaaatgatcatctgatgatcatttaaggttgttgaaaaattctggttgtgaacttctttgtctttttagttcttcatgatcatgcaggaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatc

SEQ ID NO: 6577 - DNA, 348 bp, Homo sapiens
acagcggcggcgcaggcgcggagaggcgcaggcccaggctccactccccagctgtgaaaggaggagctctacggtgactttgaagacttggaaacaggacgtgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaagaagcacaggtgatcagtggcccgtgtggcttatggacacagcagagctccc

SEQ ID NO: 6578 - DNA, 4047 bp, Homo sapiens
gatggggagggacccggctggcggggcggggcggagccggctgttgcccagacccacggagtcaaggcctcgctgagtcctcaaccccggccgagaggccggttgttaggaggtgaaatgtggatcacagcgcctggggaggcccaccttggctgcccgccctggagcgacctgaagggagggattcgagctgggagtggggctgccgcgggtcggacgcccctctagggagacccaggacccgggagagaggtagaggggagcagagacagccaccagcttctatcttctgctctaagcacattctttcacgagtttaagtttcctagatccaactggcaccaccccagagaaattataatctaatctttcattttgactttgttcttctcaaaggccgatttttcaatcccttggccgagcagtacccatcggcttttcagcgctcaccatcaactgaccatttaggaaagaattatttctaggaggttcttaataatccccaagccacaacccttaaagtgcctcgggccaccctgcacacagaattgcttgtatgtagctttatttacttaagtgggtttacatgaggttaatatttcaactactttgcagtttagatgtcagtaagcatatcatgattagcttctgggagcttgaggtttgtatttttgggtttggtgttttttgtttttgttttgtttttttcgagactccatctcaaaaacaaaacaaaacaaaaaaacctgagagaggattttgaaggttgctgctcagtgacaaatcaagcaagggaatccaagcggagaaaaacagatggcacgaacattccatgtcaaaccaaaccaggaggggtgaggcagtgcccttgtgaatgcctcctgagagttgctctggttcaaaggaaggttacgggcggaaggatgagggtgggggtgcaggaatctctctagtggcagaaggggtatttcctatggagaaggaaaaagtacctccagccagacagaataatggactaaaaaggagcttttaatattttaattttattacaggaaaacatctcctaactgcagggacacttaacacctagcttctattcagtcctgggctgctttttctagggaacttctagatgtggtactgcatttacagtaacactatctgctccccgttgatcttgtaacatctggtgtattcaataactttattaaattagaaaaatattttccacttttgaaatccagaccatcacacaaacagaactagattttgcatgcggaatgaatattttattactaggttataaaaataaaatacaaaataattttaaaacagaacttaaaacactgtacaaagctttaatatgatacaaatgggaaaattaaataaataattacacttttatgtacaggtggcctatacaaaagcactccatgtttctgccgatactctgtccttggttgcctgagcaaaattgtataaagggagctgcttggaggggaaaggaacacaataaaacgcctctggaggtatttcaaagagtagtttctcatctctctgatttcaggaagaggagaagagagggagagaaaagtggaattattaaagtcatctaactcattggtcttgttcaacaagaaagaattctggtttgtggctgaatctgatttaacagctgccaatagctcattacttctaagatgtatatctaattcaaaactagatgctcccccctccctcttttttccctaaaagctgggaacttgtaagtaaatggcctagtgaaatagacactggctattttagaaaaagggtcagaaggtagaccaggaactatgtatcaaggagaagtaagtgaggctcaagcccaggccacctaggctgtgtttattcagtccacccaatccaatgtcaaagccccaagtgggccagtgttacctttatcttcccatctttgtatttctgaaagctttgtcacctcagtggactactttggctgatgaacagttcaaatagaagattgttttggaaaaagtcccaagggctttccccttcctgggtagctccctataagtcaaattcaagttctggtagccttgtttaccccttgtaggcgagtgaagaatgcccacacagagttcagatgtggtgaaatgctgggcattgattcctcaggatttaaactgcatattattagagaaaaagagcatcatatggcaagggtagtctatataaaaacttggtttactcaatgtttttaattaggcgagtgaacacttatgtacataatattaaataatattaaactaataaaaagagaggtaaaattcctatccattgttattgtaaaattatatcatcagcaaattctatagtcacatgggctcaaagatctgcctcatccaatcttgttccctaggtcaaggaacccagagccagggtacctgggaggcatggtcagcatcgccagtgtacatatattctgtgcccatactaccactaacgcttccagctgaagaggaggcagaaaaccgttacattgcacagggccatgaaaggaaaggcttcactacttttacatgttaccttaagaccaaagatccagcaaagtctaaggaaatatcctaatcattactgtgtaatgttacttttttgctattcagtgtcttgagattgtgtggaaattcaaggtgacctgatcttgtcacatactttaattttctgatccaaatttgctgaaagggaataattaaacatcaagcttaaatatttttttaagtaggagcagacaatcacaactgaattagaagacgtcttaatgggcatagactttatttttgttttacttttttttttttttttttttgagacggagtctcactctgtcgcccaggctggagtgcagtggggcgatcttggcttactgtaatcttctgcctcccaggttcaagcgattctcctgcctcagcctcctgagcatctgggactacaggcgcccgccaccatgcccagctaattttttgtattttcagtagagacggggtttcaccctgttagccaggatggtctcgatctcctcacctcgtgatctgcccgcctcagcctcccaaagagctgggattacaggcatgagccactgcgcctggccttgttttactttttaaaatttctgtgagctgctctagaaaactaaaggacgaaaactttactgtcataattccaagttcagtcagggatttctcagaattgaggtgtgcagcatccagattcccctttatgtggatagggatccctgtgccatgtcttgcacttacctaagaactataggaattctccatgtacctcctacagtttttctagcagtgttggacaatggattctaaaggttcctgagactttgttaaatttctcataattccagagggaaggccaaaatattgagaatactcaatgataggatgagtttccactctacttccttatcctcaaggcacacaccagagttccactgggtgaggacagggaagtaggatgtcccaacaccctctgagggttttcatgcattaatcccgccatatgggctgatggttggaactgcctttagttctctaagtaaaggtctaaaaatgcacctgtggtttctgaacttgggtatacgctgatacataaggactaccatagaagttacatgccttaatcctgtaatacttttgtgtggtatcattctgctaatatattgtccacagggccaaaccccaagttacacagcgcaacagtacttgtcaaccactccatctcctcagtgacacaggtgctaaagtacctctcccctgaggcaaagtcccgacacatctgtgattgaatgcaactatagaagtattagcataaaaatatgtggcctggaaggaatctctgaagatactgaagaacctcaagttccctacattgctaggagccaagggaaggagacactgtacacctagagcgctgaattagcagctgaggttttagtatttgaaagcaaataatataaagcgagtaatgtct

SEQ ID NO: 6579 - DNA, 832 bp, Homo sapiens
ggcggatcacctgaggtcaggagttcaagaccagcctggccaacatggtgaaaccccgtctctacaacaatacaaaaattagccaggcgtgatggcaggtgcctgtaatcccagctactggggaggctgacgcaggagaattgcttgaactcgggaggcagaggttgcagtgagccaagatcgcaccattgcactcctgcctgggcaacagagcgagtctcaaaaaaaacaaaacaaattgacacatagtgtcacttggtaaatgacagttattgagatgaatacagtcagttctctgtatctttggggtccacacctgtgaattcaaccaactttttcttttcactccctaaacactacggtataacaaccatttacatcgtattagctattttaagtgctgtagacatgatttgcaatataggggaggatgtgtgatggttgtatgcaaatactacgctgtttcatataatggacatctaggcggggactggggtttcctgaaaccaactgtgcgttacatcttcagaagctttttcagttcctttcaagcctgttgcttaggttgcgcagtctacacaccaagacaagggcattcctctgcgggagtaaagggtaccatgtatctttctcaagtctttgaaaatgattatttcctgtgcttttttttttgcagagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagcctt

SEQ ID NO: 6580 - DNA, 745 bp, Homo sapiens
ccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtacctccctctgcaggatatcatgtgtatggaatgtctttcccggaagctaaaggaagcagtgaccctatatctgcgagttgtgagagttgtagatctctgtgcagggcggtggtgggaatacatgccaagtggctttacagatgccagttttctaacactattaaagaagatgccagatgttgaacagctatatggccttcaccctcgataccttgagaggcgaagagtaaggggccatgaggcttttagcattccaggagtcctagaagctttgcaggcatgcccaaacttagtgggtgtggaaacttctcatttggagttggtagaatccatttggacatatatgccccatgttcatattttggggaaatttcgtaatcgtaatggagcttttccaattcctcctgaaaataaactgaaaattcctataggagccaaaattcaaactttacatttagttggtgagtacatgtttcttgggtcacttgtaactccttgaaatgccataaaatg

SEQ ID NO: 6581 - DNA, 410 bp, Homo sapiens
acttgcgtgtacttttctgccagtatgttatatatttgagtgaaacatttatttaaaaataattagattttttttcccctctggggtttacttaggttggattcagatgccgaggacacagtacttcctcagaaagaagacagaatttgcaaaagagaccagataataagcatttaagctctagtcaatcccatagaagcgatccaaattctgagtctttatattttgaggatgaagatgggtttcaagaactaaatgagaatggaaatgctaaggatgagaatattcaacaaaaactttcttctaaagtattggatgatttacctgaaaactcaccaatcaatatagttcagactccaattcctattaccacctcagttcccaaacgtgcaaaaagtcagaagaagaaa

SEQ ID NO: 6582 - DNA, 1133 bp, Homo sapiens
ccgtggagggcactttcccagtccccgaggcggatccggtgttgcatccttggagagagctgagagctggagtacagaacctgctaaggccatcaaacctattgatcggaagtcagtccatcagatttgctctgggccggtagtactgagtctaagcactgcggtgaagaagatggtagaaaacagtctggatgctggtgccactaatattgtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagttccttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaacgtgacaacatcacgaaccacgagtccagaagcctaatccataatcctccctcctcatgacaaagtctcatgctctgtgctc

SEQ ID NO: 6583 - DNA, 2484 bp, Homo sapiens
tttttaaagcatatgtgtaatttcctagtgtttctgaatctagtattagaaattaagaaagaaagatgaaaaagatgggctggagaatggaaactagtaaaaataaaatttaattgtttttctttggaataactttatagacattatgagttgtgaaatcaccagcaaagagttgcgcttccctcctaattatagcttgtatgaaaacagtggaagtaaaatattttaatgataaaataatttcagtactggttaagcaatatatattagtcatcagattatggaattttgaaatattttaatcttattaacaagccataggatacttgaagatatcatatttgaacatattctagaactacatttctcttgggctttaattacagcatttagaaatgaaatctgggagactcttctgtgttgtagtagatgatttgtaaccctctttccataatatccaatttaatactaaaaaaacttctagtgtacaatgataatgtaatgaatatatcatacataaaacttgtattctctaggttgatgttatagcctaccttctctttcaccactgatgtatttgccatataaatcctcattacctcattttagtactcaaataattattattactctgtctccaccactggagtaagctctcttcaaggtctagggccttgtcctgtttatattttcaacacctaacatagtatagcctccttttttcttaacatatgaaagaaattgattgtcttcaaaagcagtttatattaggagctttgtactagtaaatagcccatagggatgaaagaatatgaaattaaagtcttttgcacttgtttaagctcaatttattttggttctgaagttgtgtactttttagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagtgcgtaacctttttcttctttagtgcttatttatttaattctctttttgttaggaattttaaaatattttaatctatgtgcacattttgcattttttaacatagacctttttaagcagtagcccaggtaagcttctccttgtattaatggtttttcttctacttgaaccaaattaatcttgcaagtaaacttagaaatttggaattagcaaaattgattgcatttaaaaattattcttgtgaaattccatgcaactataatttatcttaccagtttaaccctaatgtatcacagaaataataggaaaatagcaggtggcagtcacttgtagtaggatttatttagtttctgttttgagaagatgtagtcttttaggtataccattaagtctttaaattactcccttaattccacccgccaattctaatgcttacatgttccagccccactcccggctcacactcttaggcagaaattcattgctcctgtaaattaagtaataattaataccgctaatgagaaatctgggagtacaggaggtgattttaaaaaatgctcgtatttcctttgattagagtagcaattgttagggatacatgagccagatttggttttatgtaaaaaaaatctttcagttgatgagttcttgtttaaattgtattgctgtggcaatttcttattgtaataatatgtaggagaatttctaatttgaatccctttatttacagaaagctcactgtaaatttgtaggaatgtcatggtactaccccattaagttatttttattagtgtttagttattgattcagcagtctctaattgtgccaaaaatggtgcttagattagattgccattgctacccatgggagctgctacttaattattcccacctcaaattcccagctctcaagttagcactactcctttgcaatttactccttctctgctcgtataaataccctcagatgatgatagttggtggccactatacctttgaagaggttgcccacttctacatggaaaggaaaagatggtttttttttttaaaagatgaatttgataattaacttgccactatttcaccttgtgatgaaacctcaattttaaacatagtgttaattgttttattgtccacagaattaagggtaagtaatgtcatacaatttttgtctttagtcttttagtatggtttctttaacttctattgagcttctgttgcagatattggacatgggcgtatcttctaacgatgtcgtcaccattagtatattcttcctgctaaaaataaatatcaaaccctg

SEQ ID NO: 6584 - DNA, 2802 bp, Homo sapiens; identical to SEQ ID NO: 4606

SEQ ID NO: 6585 - DNA, 724 bp, Homo sapiens
aatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctgtaagtaagaaatttttctgtagatttggttacctagattgctaggtcacttttccttttgtgaagatgacttcagctcagattatctgattaagatttattttctataaaacaaaaatataactttgtagagataata

SEQ ID NO: 6586 - DNA, 574 bp, Homo sapiens
ttcttttgaagattaagaaaaatctgtcacttaaaagaatccaactgaagttgtgaaaaaagtgattttgattgtgctgtttgtgtttaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgt

SEQ ID NO: 6587 - DNA, 11563 bp, Homo sapiens
tatagagcagtctcttgcttcacagttgtcaaaatcccacttcatgaacgatcacagaccaaatggcagaaaacaacccagttgttttcccagttgtttctattcctaaaaattgcataggtgggtacatatcgtattctgttgtgttttctgaaagcaaaggtactgtcatgttattgtggtctatgtgcatatcgctgtagttatccatgctataggtaaaactgttgaaaagaattatttaattgtggtgataaactgccttagacggagtctgttagacgtgccttcttatggtgtttatgccttagctgtctcttcctgaggaaatgtatgaataagaaaggcttcttgatattttgaccttagacttgatatctaatgcaacacccttcctcccccatttataggaatagtactcattcattgagtactattatatgccagacacacgacgctaggtggtttgtattatctttatatccacaataaccttgatttaggtagtagtatccctgttttactgtgagaaaactgaggcccagaaaggttaagtgataattgtatggctagtttgtgataactatagatactacaactaaaaatttacctttctggttcttttttttcattcttacctttctctagcaatacatatttagctctttagagctagttacaatatattttttatgttagacttactgtgtggggagttttgaatttaaaaactaaaaaaaaaaaacaccagaaggtttattctaaaggtttaaatttttaaaatttaatctgctgttgtgtgcttctgttacccctgaccttagttagcattgcaggatactttcttttccatattttgtgattgatatatgtgtgattctttgtatgtacaaaagcttgagcttgagttttttagaggaaaggaataaaataaattaagttggttgaattaagtatgtcttggtggatttggttatccccacagcaaacttgagcattcagtttacccatgattaagggtgctgatactatatttaagggcgttctgccttccatctcttttctaatatcaatagtattaattgatgccaggcaagaggagtgctgccatatttgggtcagctacttcgtcaagagtattttgcagaatgtacctgaagctattctgaaagttaaatatcattagatacattgtcaaaccctgaagctgaaattccagccattcagggagcccctcagggagatcactgcttttcccttgcaaaaataaaaatagtgtataaaatactatttaaatatatactcttatctaattctaatagctagtatttgttaagtgcttagtaagtgccaagtgctgttcaaattgctttttaggctcacacctgtataatcccagcactttctgaggccaaggtgagaggactgccatcttgaaattttttttttaaagtactttttaggtgttctttaaaataataattccactttacagatgaagacactgaggtgcagggaggtttaattcaccttttttttttttttcaagtttacagcaagtatttagtcattgagctatcattcaaatcataataactagtctttacaaaatagagccccaaagtgctatagataaaaggttttcattttgctttgctttttaactttggtgttgtctcttttcctttctttcttctcccctcatcttctctctaccctatggtctgttttggatttttctcgttatatataagctttaacttttgcttttcttctttttttctccccctttctttttgaatggttttagcatccttgggcgcagaaaactctggaaatgtattcataagtttagaaattatataagacacttcagaatgataatacttaattattttagaaatttccattttgaattatattgtttagggggagggctattaaagtgttctctgccaatttatgatacattttagatttcccagtttttttctggatatctgtcaggagatggtgtagaggtttggtaagtaatacagtttgattttgtatgtctcaagggttactcattcagtcacatatttgagtttattttattctggcctttttcccctctggggattctatttatagtattaattgaaaatctttatgttaatgctaattttgatttttttttccactagcatgtattggagcactcaggcttgaagaaggacataggtaaaaagtataaaatggaacattttctaacattagggttgtgaaaattttcttattgtttagttgcatacttggcatgttcaatctgaaaaaaaattgtttatgaaacaatttaaatgatattgtttaagccaaaacagttacttatatttcatttctcttttatttttataaatagagcatcaattcccttaatcacaaaggtcaagaaaggttatctcatgttacattaggacatacttaggacttcgtagtatttcccttctgtgtgaaattttatccagaagacttgaattacttaatcgtaaagtgaatagcaaacgtgaatctaaaacatggtttcagtttttcagaatcaggcctgctttgtccctaaatgctttcttatttccccagagcccttattggatttaagccccatatcatatctcacatacctgagacagacataccacagtgaaccctgcatgtccttgtaagttcttttccgtgcctagaagttgcagaagaccaaggaaccttggaagtgacttactcttttgcttcataaagttgctttaaaacagcctttattttaattattaacaaggtatgtcacacatttttaaattttaaggttaatttagtcattaattctgtcaaacaagtgttctttggaaactagttgtcttcaatgtcttttacttggagttacttgaagtttgcttaaactttattcacttggagtagaacttcctagttaaatgattgaaaaggactagttctgcaaaatctatgagaacaagagcttctgcaaatgcataatataaattctcttccttttttttttaaactgtatttttacaaacctagatctcttcctgctttgatttgtctttatcatatctttcagaacaaacctttgatggaattctaggaaaggttgagattaagaatatattaaaaatattccactttgtacattctgtttatattatagtaaactaagttatttagcaagataaaattaggaatttcacccaaggtatcaatcagatggaaccattagtccactgaagaatttactttttaaaaaagttagtggaggaaaggagaagatgctgcttaagagtaatcagaaataaagatggtaagcatcatatggtaaatatatacaagtttcgtcaattttgtaaaaaaaaaatacaaagatggtaaggcatctttgaaattgttgtcagtaggaaatttcatctgatatatatatatataaatttgtttcataaagcaaggagaaatggtgtaaataatacaagtgtggctattgacatatgaaaatgtccatttattttgaaagtgactacccccacagattatataactgtagaatcgaatacaaattttctcacttttcttccttgctttggcatttttttaaaagttacttgaaagttcagtttagattgaaaaataagggcctgattaatagcgctgtatcatggtattagagtacatatgttagtattttcatgaaagaggaagagggtaataactgatttacctatgattaaaagatagtggtgacattttcctttgaaagtttgggctagaaatttataacctttggccaatgaaactacagtagcttcagtcactgcttccatgccacatctctacctaaagggaagatggaatccgccttctcttttttttttttttttttttttctgagactgaatctcactctgtcgcccgggctagagtgcagtggcataatcttggctcactgcaacttccacctttcaggttcaagcagttctcctgcctcagcttcctgagtagctgggactacaggtgcctgccaccacacctggctgatttttgtctttttggtagagatggggtttcactgcgttggtcacgctggtctcgaacttttgacctcaggtcatccacccgtctcagcctcccaaagttctgggagtacaggcgtgagccaccatgcccagcctgaatcccccttctcaaaagtaacttccattcactttgtccctggcagtctgctggtgaccatgatttctaaggctcactcatgggaccaaaggcaagaagaaagggaggagggtggtaaccagataaactttgcaacccctttgataggactttttgggtgagaatttttatgaaaagtaatatatacttctactatagatctgcctctagtttcaacctctagttttagcactgattttttccccttaatttccagaagcatgatataatatctttttcaaagaaagtgggaagaatgtccacagatgttaggagaagacaattatgtaggaaaaatattttctcaaattaaaatttaaaacaaaagtttgcagggaatggagtggggttcagcattagggaggtaggagatgataaaaatacatattaagtaatttgtaccctgatatgctttgtatgtagattgcttacaactaacatgaaatgagcatttcattccttaagcatgctgttgggggaaaatgggagccaggctggatgcacaaatttacaccagatgctctgtatccaggtagcagaaatgactaacagcactggtatccatcagtcccagagcaaaagcgtctccagaggaggacatctgtaaatcccaaatctgatctccttcatcatcattaggcaacagataggataagacttcatgaagagaattttggtggctttagattgttgagaaagtatatataggaaaaaactggaaattatgtccaagattttttgtctaactccttatcctgatattgttaacatttcacaactaaaataattttaacagacaattagtttttaaaaatgtattttcatgacctgagactacagaaattgccattttcttaggacgtagtttacatttgactctgcttactgtgtccagggcatccccaaattgggagagattgccaagtcagttgccattttgccttacttttaccaaggactagcctacaggttcagttttgctcttgactttggccctgaattgagaactgagtcaagagaacagagtggaagtatggagacaaagccagcagctttactcaaaaaatatatatgagtctagtattttttttgtttttgaaagacatgttactgagcccaacccagtcagggatcactgaatattgggttaaataaaacaataatgttattcatgtgtttgaaattaatgttttaaagaaccacgcacacactttaaaatgtaactggatttgctatataggccagagaaatatggctgttacgatgaaggcgtaacttctctggttcttgattatttacaccattagagaagaatgcaaatatgaatagctcagagtagtttaactttgaagtgagagtttatatgcacctttatatgtgggataactgatgtctttggaatagacttcaaatgaatgataaaaacacctgtaaagtgataggacctctactttttctcatgtccaatgttcagtttcttataaaccaggcatgaagagaaacaaaaagtaattaattctccagatcatgaagttgtcttcaacctaagcacagaggtataataattacatttctcagaagttccccctctgttttgagtctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccaggctggagtgcagtggtgtgactttggctcactgcaacctctgcctcccgggttcaagcgagtctcctgcctcagcctcccaagtagctgagtctacaggcgtgagccaccatccccggccaagcagtatctttttgctttgaaagtgacttacatgtacatttgttttccttgtgaatgtttctttttaactgcaaactaagaaacattgagcccagcattcatatatttgcaaactctgtcttacttaatttctcagtttttttcctcagaaaaaatgaaattccttttcttttttaaatttattttttctttatttttctttataaagtgaagagtaggtagcatgaattcctcttgccctttgctatttcagtctggcatcagtagcaattgttgctatgtccagttttcattcatggatttttctgggattgaagatgagttcaatgttgattatttaattgggcagtataagtaaattcattggctctccttccagtttagtgaatactaaatatcatccatgatattttatacttcttacacttctggaatctaacctgaaaatagaagttgtaagtcagggacggtggtatgtgcctctagtctcagctagttgggaggctgaggcttgagcccaggccttcaaggctgtagtgcacaatgactgtacttgtgaatagccactgcactccagcctgggcaacatagcaagactcccaccccttaagaaaaaagaagagagaaaaaaatagaagttgtggagagggaggaggatgcttgaatactttgaccgtacttggcataatagacattttgagggtttttttgttttcttaaaattcctctggatcagttttcattgtttctagtaattatatttatcgttaatgaattcatattctgctctagcccctaaagatagtttgatatgctaacttttgttttgcctttctagctgctaagatagataatggttattgcaaaatgcacgtttttaaatggtctccagtgtggattgcttctgagctgctgatggattgaatacattgagaaggaatgtgtcatttggaatccaggaccagtcagcaaggataactgcctgattttatggtcagaatgctctaactcttatggcatactgatgactttttcttccattttccaaaaaagcaagttttgtcagtctcagtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttccctgtttactgtgtctgaccttcaagatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtgagtgagttttttttgtcttatttcccattagattctctaccttctttgttcactttacgtatgttattgccactcccttcaaaactggtggtttaattaaagtgacagcatcttctatatacccagtactgttgaggattaaaaaatacatgtgtgccggatgtggtggcacacacctataatcctagcactttgggaggcctcaggcaggaggattgcttgagctaaggagttcgagaccagcctggtcaacgtggcaaaaccccatctctactaaaaagacagaaagttaactgggcctgatgttgtgcacctctcaccccagctacttgggaggctgagaggtgggagggtcacttgatcctgggaggtcaacgctgcagtgagctgagaacaagccactgcactccagcctgggcgacaaagcgagaccctgtctcaatagaaaaaagaaaaagtgccaaggctttgctcctagttcggtgcaggttccaaccagtactaaaactttgcaaatttttgagggaaaaaccagaagttgtagaatcaatatgagcatttaattgtatagcaagcaattgtggcagaaaaaattcaccctagtgaaatcaagttaactattctgtgaatgagattaaccagaggaacaattttgaccatgtatcttttaaatcactgtttctcaaacttcagtgtgtatgggaatcaccagggatcttgttaaaatgcagattttgatttagtaggtctggggtcaacctggagaatttgaatttattttctctttttttaaaagtagtttgaaatatatttcacataccataaaattcactctttaaaactgtccaattaactgttttttagcatgtagagttgttccactatcaccattctaatttcaggacattttcaccgtgctgaaaaagaaaccttgtacctatcactccccatccccctctcccttccacccttttcccctccaccagcatctggcaactgttaatccactttctgccttaatttatatcttctggacatttcataacgttttatagacttctgtacctggcgtctttcacttagtgttcaaggttcatcgatgttgtagcatgtatcagtacttcattcctttttgtggctgaataatactccattgtatggctatagcacgttttctgtgtccctgcatcagtttccattttttggctattatgaataatacagctatgaacatttatgtacaagattttgtgtgaaagtatgttttcatttctgttgggaatatacctaggagtggaattattgggtcatatggtaactaacattttaaagaaccgggaaactattttctaaggtggctggaccatttgagagtgcattcctgacaagcatccaggtgatactgaatagcaggctctagattacattttgacatctatcaagaaaacaggaacatgaactttaactgagttcagctgccaaaatctggccagcagcaaag

SEQ ID NO: 6588 - DNA, 5789 bp, Homo sapiens
ccggacggctgagggcgggcgacgggcggcgccggcggacgggccgcgacgccagggaaggtcaggcggcccggggcgtcctgcgactgcccgaggtcggaggcccggaggacccgccgccgcctttgtgtcaccagcccccgccccgctggactggcccgggccggggcggttgggccggcgctgaagaggcttggccgcccgggtccacccgttcccggatccgcctcggcggcccccgcgcccgcccaacccctgcccaacccctcggctccgcgagtttgggtgagaagtgcggcggcttttcccagggatggagtttagaggacgctaatcctatgtgcgagcggcggaccccgcccggatttcccggaggcgcccggttagtgaggcgacggcgcccacccgcgttcgcgggctcccgaccgccactccccggagccgccggcccgccccagccccgcgcgtcgccccggagggcgggctgcactccctccacgcacctggctggcagagcgtctccagggacaaaaggtgccctggcatcaaagccgagcccccgcccccgccgggatgctgccctccggaaggaggggcgctgcccccaaggtactctccccgggcacccagggggaggttccatttcaacctccgatgaaaaacacggccctcccgggtatttaggagggtctgagggtaagtgccaagatggagaaaacacaccggcccctcacagagtatctcctgaggaatgacaactatctagtgggcaaggagggcttcctgcatagcagagggcaccccctctgatcccccaacgccaagggaaaaaaatcactcttcaccggctcccctgagccaggacaggctccagtgcagccacccaccttataattttccgcggatgctgccttgatcagatagatctgaagatgactttaaggactacaagcaaatctcaagggaaaaattcagaccttgaacaacagccttgaactttttcagggttagacaagtactcccctgtggagtttctgcccttatttcttcgttcttctgttaattcttccatattttaacagaacacagacctgccgaaacgacacaggatggcgctttgctttttgttagttctccaaccttccaaacccttggggcacatgcaagcactgtggaaaaactccattaaaccaagagtcatcttactccagatcccagactgcttgggaagttggacatgcatattcccaaagagaacagtgttggaaggagacaggagagcagctcgggggttgggggtagagggtaggaaaagagggcaagatggatgactaccactcgaggccagcctccactgcctgttagggcagtagaacctaagagccggtccaaggcaacacaaaagacagtgaggctaggtctttcattgcagccaacgatcaagaaagcaactccatcaaatgacactgtcttttaaaaaaaaattttttttttgagacagagtctcgctctgtcgcccaggctggagtgcagtggtgcgatcttggctcactgcaacctctgccacccgggttcaagcagttctccctgcctcagcctcctgagtagctgagattacaggcacgcgctaccaggcccggctaattttttttttttttggtggagtcgaggttttgccatgttggccacgttggtctcgaattcctgacctcaggtgatccgcccatctcagcctcccaaagtgctgggatttcaagcgttagccaccgcgcccgaccaaatgacactgtcttaaatgatttaatgtcttaaatcgggaaaggagagtaagagaaagcactcaacggagtcagaggtgtcttgcagcctagctctttccacagacaagctacatgggcctatcatctaaccttttcaagcttctccgactgcttctgtgttggagggatttgggctagaggatctttttatttttttttattttattttggtgacggagtctctcactgtcgcccgggctgaagtgcagtggcgcaatctcagctcactgcaacctctttctcctgggttcacgcgattctcctgcctcagcctcccaactagctgggattacaggcgcacaccaccacacctggcctattttttgtatttttagtagagacggggtttcactatgttggccagactggtctcgaactcctgacctcgtgatctgcccacctcggcctcccaaagtgctgtgattacaggcatgagccaccgcacctggcctgtgatcccatttttcaaagtaattaggctgggtgcagtagctcacgcctgtaatcccagcactctgggaggccaaagcgggtggatcacttgaggccagcagttcgagaccagcctggccaacatggtgaaaccctgtgtctactaaaaatacaaaaattagctcggcatagtggcacgtacctgtactttcagctacttgggaggttgaggcaggagaattcgcttgaacccgggaggcagaggttgcagtgagccaagatggcaccactgcactccattctgggtgacagagtgagaccctgtctcaaaaataatgataataaaataaaagtaattatttaaggctgggagcggtggctcatgcctgtaatcacagcactttgggaggccgaggtgggtggatcatgaggtcaggaggtcgagaccatcctgtctaacacagtgaaaccctgtctctactaaaaatacaaaaaaattagccaggcatggtggcgggcgcctgtagtcccagctactcgggaggctgaggcaggagaatcgcttgaacccagaaggcggaggttgcagtaagccgagatcacaccactgcactccagcctgggtgacagagcgagactccgtctcaaaaaaaattattattattatttaaaataatcattgggcctggtgcggtggctcacacctgtaatcctagcactttgggaggccaaggcgggcggatcacgaggtcaggagattgagatccaacctggccaacatggtgaaaccccatctctactaaaaatatttttttaattagctgggcgtggcggcgggcacctgtaatcccagctagtcgggagactgaggcaggagaatcgcttgaacctgggagtcgaaggtttcagtgagccgaggtcgtgccactgcaatccacctggccaacagagcaagactctgtctctaaaataataatttttattattgttattcttgacaggccagtgtagaacaggtggggcatctatggtgacagaactgggttccaattctgtcccttcacctgtcccaggttcctcatctgaaaactgtgacccagtaaacctaatttcatgagcagctttcattaaaattgaaataatggtggaaaatgccttgtaaccgtgcttgatgtagagtagttacttagccagttatttcctctcttcttcccattcctaacaaaatggaaaaacgtttggttgctaggaaagagccttaaggggattttgttgttgtttgactctatcgcccaggatggagtgcaatggcacaatctctgctcagtgcaacctccgccatagacaggagccaagcgtagtggtgtgcacctgtcggtagttccagcctcttaggaggctgaggcaggaggattgcttgaggccaggagtttgagtctagcttgggcaatatattgaaaccttgtctcttaaaaaaaaaaaaaaaaaagaggccaggtgtggtggctcacacctgtaatcccagcacattgggaggccgaggcagtggatcacttgacaccaggagttcgagaccagcctgggcaacatgcaaacttatgtcttttaggccgggcgcggtggctcacacctgtaataccagcactttggtaggccgaggcgggcagatcacgaggtcaggagatcgagaccatcctggctaagatgaaacccagtctctactaaaaataaaaaaaaattagccgggtgtggtggctggcgcctgtagtcccggctacttgggaggctgaggcaggagaatggcatgaacccaggaggtggagtttgcagtaagccaagacagcaccactgcactccagcccaggcaacagagctagacgccctctcaaaaaaaaaaaaaaattacatctttaaaaaaaaatgcagggccgggtgcggtggctcatgcctgtaatcccagcactttgggaggccgaggcgggcgaatcacgaggtcaggagatcgagagcatcctggctaacacagtgaaaccctgtctctagtaaaaatacaaaaaattagccaggcgtggcagcatgcgtctgtagtcccagctgctggggaggctgaggcaggagaatggcgtgaacccaggaggcagagcttgcagtgagccaaggtcccgccactgcactccagcctgggcgacagagcgagactcggtctcaaaaaataataattaacaaaaaaaaaaaaatacaaaagttagttgcacatgttgccatatgctcgtggtcccagctactcagcaggctgaggttgggagatcacttgagcccagaaggtggaggttgcagtgagctgagaacccaccattgtactccagcctgcgtgtcagtgagattctgtctcaaaaaaaaaaagaaaagaaaaaaaatctaggctatgctccctagtatgggaaatctagtctagtcatttgacagaatcaggctttgcaggccatattgtctctgtcgtaactaccaactctgctggttaaaagggaagtagccacaaacaatatctgaatgatggattatggctgtgttccaataaaactttatttgcaaaaacaggttgctggttgcaaggtagttttccaacctctacgtgattctcagactttaggttgcatcataatcacctggagggcttgttcaaacgcagattgctgggccccacccccagaatttttgattcagccagtctggggtggggctgatatttgtatttctaccaactttccaggtgaggctggctgatgatggtctggaaaccactttgaaaacctctgaagcttttctcaactcccttctttgtgtacctaaaacactttatccctactgtagatgtagcattagcgtgttatattagtttagtgattggtgtgtgggtctctgggagcctttctgaatcacctccctagcctagtgcctgacaatagcaatttgctccccattcattgactgaactgaaaccggagggtcatggtcatcatcattgttccaagccatagatagaagatgaagtcaccacccctgatctcagagctcatcagagtagagcttgggctggaccctgcccttctctgcagtgagcagttttctctgtggagctctgtgcaacctggagccagtcctgcctggggtaagaggaaaaaagactccttccccccagccccacagcctgtacgcaaacacaccgggagacatgacctgctcagaggagacctggaaccaagggaataaaatgagagtgggttgggggctgctgttagttattttttgcttgtaagtggacaatttgtggtgtggtgtgtgaatttggggtcttaaatccagatagctgtctgctgtggacagccactgtttctgaattacagggcatttcaagtgacctgtggtcaggatgttttctcagatcaggcaaaatcaattggtcctgataataaccaggggagttgtactttccctatcttgagtagaagaagccacagctcccgggtccacctgcct

SEQ ID NO: 6589 - DNA, 2228 bp, Homo sapiens
atgcccggtgtcccccggccgccgtcggcgtcgtgtcttcagtccttatcgactccagactttggggatgcgtattaacgccagactcctgcaaagtcttgccttcaacactcagcccctggggagagacgggtggagggatgactggaaacgtggcctcgacgtccctacagagcccctccagcgtggggaggcctaagtacctcaaggttcaggcccacggaaggagtcgggggagcgaggcccggtgatctacgtgtgaaggagcttggacaggacctcacaaacgccagggagacggcgagggggttcgtgcgtttgtaacgtcttgacatcgctgatcctcccgcaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggtgaggatggtggggaagcctgcgtggggcagggaacggtgaggcaggaagagggaagggcagcagaggcctgagtggttgcaggttcacacactgagctgccagtaactgcccagctcagacgggctcaaattcagaagccaccattgctcctcacccccacccccaggtcagctgtccactagctctgccatgacttgatactgcagctcaaacagtgccaaccaaaacccactctcctcaccgcctgttatgggtaacacggtatggttacagctttactcatgtcctctttccccaggctggtagctcagggatgtctcgtctgtgagttacagctgcacgctctccaggaaagaaggaatttcctcttctctggaaaccccaccacacagctggtttctcattggtgctgcttgcccattccctgagctgtgactgccagaggagtgggaggttggtggtgcctccagcccatcaggggcaggccctgggaccgcctgggaacaggaggactatggcacaaaccgagtgagtgatgggagcaacccgcagggctctgccacatccctgtcttccttcactgacatgaaacgcagaaaaggcagctttgccacaacacaggagcacgcaccgaatgtggccgcccagggctctgtccttgaccctgttgtccaggactgtttaccaagggctgacaggcactgagtgccccgtgcacctggccagacactgcactcatgcagcggaaaggacagtgaacgagactttgtccctggcctccaaaggcttagggcgtagtggctgtcatgaggcacagtgacaagggccaggagggggacctcttagggggccatgcagtgatggaagccagaaggaatgaaggcctgcagtgaggatggagtggtcggcctgaagccatctctagcaagtggtcaggacgctgattgttctgcgcaggttggaggtaggtggtgagtctgagaaaggggccggaaagactccccagcaactgctggcaaagggtgaagggcacgttcccacaggattcaagccagctgcctttggaggggagacgggcactcagtttaggcgctcctacagcagggtcagcaagacaagcaggttgcggcaagggtctgcgcactgctgtgtaaatgtaggggcatcggggggcagaaagaccaggggagaagtgtgcatcacccttggggttaagggacagttgtctgctaggtgttgcttcctggagatggctgaaaagccagtccagtctgcagggaccaggccaccacccacctgatgtgggagcatttcccccaatccctgctgggctgctgaatctgggggacatagggaagctgaggctggtgttctgagtagtggcagagctgagccacagggcatgtctgaggtcagccccgagcaaaatggaatagggactcagggtgggtcaggtaactggaaagcgggcactgtgcacgcagcccttgaggggagccagggtgggtggggatcccccactgtgtgcagaaggcagcagccttggaagcagggtgtgctcctcggtgtggtcgctcgataccagaaaatgactctaaaaactgaagagtgtttgagtttcattcacacaaaacatggacatcatctgtgaggctctgtcccagagagacagggccatccctcatgtctgttattgggttgtagataaacaaaagtataaatcaaac

SEQ ID NO: 6590 - DNA, 1851 bp, Homo sapiens
agggaggggcacagggggctgaggagtgctgggtcgggcttccagctccctacaacgcagaccagtactggagttcgtggtgctggaagaccgccgcccgactctgggccccgggtaggaaacgtaagtgccaggaagttagcagagtggttctttggctggcgcctgaacctcgccagtcttcgtcgcccctcccctgccaacgcctaccccgcttcgaccggagggtgcgctgtccctctggtcactgtgatcaccgtccatggccgcctgcggatacccacgccgtgctcagaagagggctctgaggccacgcccgcctgtggggtcggtggccgggcttccgggaccccagagggagtcgtcgcgcgctaggtggaggggacccctctggaatccggcgatccccgggcgcagatgcaggagcgggtggggagagccgcgttcctggcatgtttgcctcgagttagtcacgaaggaatcgaagagagccttagtcttcgaggcttttcccttcctgtgagcccctttgaggccagcacattgatttttttttctttcgcagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaattccttaaaataaatctctttctgcatataca

SEQ ID NO: 6591 - DNA, 3339 bp, Homo sapiens
tgccaccacacccagctaatttttgtaattttagtagagacagggtttcaccatgttggccaggatggtctccatcttttgaccttgtgatctgcccgactcgacctcccaaagtgctgggattacaggcgtgagccaccatgcccggccatgcctgtgatttttaaattcttaaacatgtattatttataacttaagacataaagacactatagtcacataggagaaaacaattataatccaaatgagaaacaaaagatctaaattaaggaggtgtgaagataatgtagaggttgtatactatgaccattttagaaagaggattgtaggttttattgactaagaagataaagggatgcaaattagttatacaggttttaattccagacaacagaatagtggctattaacaataaaatcagtaagtattctggacatgtttaacttgaatattcaggtaggggattttattggaaatacggatctagagctagtggaagaagttatatttaggagtcatccacaaagaggcttgagaaacaaatgaaaatgtattgagaagtgcatagagaacaatgttaagggggctgtggggaaaaaacaacatttggaagataactgaaggaaatcatagaggaaaaatagtacaatctaatttttctccctaactgaaagcaaaaccacttttaatactaagaatttattatgatctctccatgatactaccgttttttcaatcccaacaatcatcatcacatcccagagccatctcatgacaagagctttctaaatactaattgcctgaacactgaagaaaattaatatctgatactaaggtgtaacttatttctctgtaattaaaaaaaagggggccaggcacggtagctcatgcctgtaatcccagcactttgggaggccgaggtgggtggatcaccatcaggagttaaagaccagcctggtcaagatggtgaagccccatctctactaaaaatacaaaaaaatagccgggcgtggtggcgggcgcctgtaatcccagctactcgggagggtggggcagagaactgcttgaacctgggaggtggaggttgcagtgagctgagagcgtaccactgcattccagcctgggcaacagagtgagactccgtctcaaaaaaaaaaaaaaaaaaaaaaaggctttctgttcttgaaatattcaaactagacaggacaattttaactgaagctgttctcacaaccctgtttttcagctattataagtttgttaatggacaaacatgttcataactgaaattttaaaattacataaaagtataattctataacctgcagaactaacatttgatgcatttttcctagtcctttcaatgcttagtttttattacatgtatgtaatatcacttattgaaggcttactaaatactgaaccctgtattaaaacactttcctgtcttgtccttccaaacatcctgacactcaaaagttaagtgatctgcacagggtcatagctagaatttaaaagctgctacttacatctcagatatgactccaaagcccaatcttcactacaaaactgcaatacctgctttccctctcccccacttagcatagtttcagcatttcccagaacattaacagtaataatttattggcaacttgacctcttattgtatacatacagcatgatttattttcctattcacctagtactagccaaatgtgtatgtatattgctattataaacaaccctgtgattaacatctttctatcaagatctgcctctactttgaacagtttccttattgccaatagttattttaaaataaatagttattttaaagggaaattgacacatacatataacacactcacgcaaaactggcaagtagcagataagtgctcttctaatttcagtttcctagctttcatgtagaatgaacaattatagtaataaaggctgaaggaaaacaaagatattattgagatacaacagggacagtctaaaacagcatcagaaagcaagttcatgctgttcaacattagcaggcaagggaaatagggaaagaaatacgcaaacgtggctatcacagaaaagccagcttattactttaggttctgtgggagactacaggtcacataaaagcagtctcaacaataatgtgaccacatgtgcaatcaacatttacaaaatgaaattatatatcatgtataacacaaatgttttgcctatactttaatttacaaagccacataccgaatgactgaaatgtacataaacattcttttatgatagaccagaacatctatattatcatgacttagaaaaagaaaacagatgcaaaatagtgttgagaatttctggcctgaaattacaagactaagtgtgtgtgtgcatgcgtgtgtacatatatttaaatcgttttattctcatttgatccttttggctgaactttattcatatattatctgcccttcttcttataatctctctcatgaaagatatcattatccagtcattgaagccaaacccccttcaccagcccccaatctctagacatcaagggttaacaagacatcttcctaaatttctccggaattaagctcttctctgttagaatttcctttccaagtccatttcttcataaatctggcatgtgaaatttgaattgctctgccgcagttttctcttctttagtcagtggtgacagctagaaaataaatgataaaatctttatttcaaaaactttcaaagacttaaatcagtttagttaacttctgcattgtcacaccaataaatgtttccctaagcttatactatgtatgtaatcacagatttagaaaggcaagggaaaaaacagatacttggctatttatatacaaggtcctatgatgtttgagcttctaaagaacttgcaattaagttgaagaaacaagaccaagaaatcaaacaatttaaggattatagcagaaccaaagaagtcatgtttggatgccatattctaaaagtacagtcaaccctcagtatctgtgggagattgattccaggataacaaaatccacagatgctcaagtcccttatataaaactgcgtagtatttgcatagaaactatacatatcctcctgtatactttaaatcatctctagattacttatatacctaatacaatgtaaatgctatgtacataattgttacactgtattgtggaaggaataaatgataaggaaaaaagtctacagatgttcagtacagatacaaccatctaatttttttccaaaatttttgttttctatttttgaaacggggtcactctgtcgcccaggctggagtgcagtggcacaatc

SEQ ID NO: 6592 - DNA, 514 bp, Homo sapiens
agtgcgtgagtttccctttgtctatgttaagtctaggctagccagttcttctctgcttctatacccgggagctgaggggcatgcagaccttgaaatcccggcaccgctccctccaccccgagcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatgg

SEQ ID NO: 6593 - DNA, 503 bp, Homo sapiens
cttgcagagctactgctagttgtgggaggacggggagacaggaggaaggcatctggagagcaccatcctgcctagaaggcagggttttccctgtaactggatctctctgtaaggagcacagtgatgatctcttctctccaccctcactttctcaccccctaccgaccattccttagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaagtcaggcactttccctggggccttgcttcctctaatcctcccactgctggagctctct

SEQ ID NO: 6594 - DNA, 3165 bp, Homo sapiens
acaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaatagaccaaaagaaaagaaagaaaagaaaacctttctatgtacagattctaaatcgtactccccatacagtcagaggcagggagtcgagggcagaggcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatcttgtcagcttagtgctttaagtgattgcatttaaaaaaattctgcattttcagtttttagcaggaggaatggcctcaactagtggttttcaactggggatgatttttttcccctaggggacatttgataatgtttggagatgttttagttgttagaactggggttgggggaactactgtcatctggtggggagagaccggcaatgctgttgatcttactataatgcacaggccacccccaacaacaaacaaattacatagccccaaatatcaataatgccaaggtccaaataacctaaccttccattactgaaaatagaagttcaagaagatagtttataatttaaaaatttttaggtcttaataagttgtcatactttcacaggttttatttcatactaagtaatttatttcaaattttacattccaattacagaaaattttctaagccagtttttgttcttcatgagtattactatcaaggtcacatttttcatctagtatgttttaccctggtacttgttggcagggtcaggactaaggtgagatgcgcaaggcatttgcctcacacaaaatgcacaatgaataaaatgtcaaaactttaaataaagacagaatcactaaaagtactttgccatattggaacctgaggcaaaaagaaaaataagtaataatatttaaaattttgatctcttgttcattgtagatttttacattaattttgattgtttaaaacattgcattaaaatattatttaatgtg

SEQ ID NO: 6595 - DNA, 577 bp, Homo sapiens
aatctgtctttctagcatgttgccctttttcaaccacatttgtgtttcaggtgtagagaggagagagagtgaacagggagcggggcttttgtctgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttc

SEQ ID NO: 6596 - DNA, 721 bp, Homo sapiens; identical to SEQ ID NO: 2406

SEQ ID NO: 6597 - DNA, 1633 bp, Homo sapiens
ggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagaggtgagtgtggcacttaacctctcctgggagggggaggaataaggcagtgtttccaagaggtgattttggagctatacaggcattaggtagacaaggaaggggaggtccattctgggtgcctaggactctaattacacgctttccattgtcttcctatagaaaataggagtagtacacttatagatgagaaaactggagaaagacatagtgaacatgtgagaatcttgctctactaattgataggaaggtgactagaaattggcgaagttttcttggtaagttgaggagaggacttttcttatagtgcagtctggtagctgaaccgccttgcatcaagaccaatgtagtcttatttacagaatgccacatcacagtgaattgtgctgtggacagcttccagtgtgtgagttgtggaagatgatgattttaacagattttggaggatgagaagtattaagaagaaggccccactgtccatgcatttgctctgctttttacttttgaccaagtatacacttcagaaatatcttattggatgtatacaaagtgattgtgtgtcatttgaaccagcaggaagtaatttattaaacacacttttctaaataaaagtcatttaattttatcagaaatcagtgtcattttagattgcaagtctcaaaccaactttccaattctgacttgtaagggtgccttaaatcctgaatactgtactctgtattactaaacccatgttagtttacgccaagattctgtggtggttttacatattctttttcccctttgttaaggtggggaggccacagcttatgtgaatgactttctcaggagttataaagtgatacaggtaaagctaagaaaagaacagattttgataacttttgttttaactgtccagtgttagggattgtggctacagtggtctaatttttaaaaactcttttttttgcttacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagac

SEQ ID NO: 6598 - DNA, 731 bp, Homo sapiens
aaataccgcggcgcggacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaaggtaggttgccacctctgttctcccagagacatcatatactagggaggcagtacgtcatagaggttaatagcacagactgcggagtcagagtgccggatgtgagtctatctctgccacttagagcttaccatgggcaagttactgaatcccccagaccttagcatactcatctgtacaatgggcagaataatagtacattttccttatagggttattgcgaggagtaaataaatgaatatatataaaacacgtaaagccttgcttagcacatagtaagcacgatgtcagtattagctatattattaaccaaagtg

SEQ ID NO: 6599 - DNA, 694 bp, Homo sapiens
gaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtggtgagtgtcttcttccttccccaaattcagcagaggagatacaagggtatttgatgagggctgcagaacagactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctg

SEQ ID NO: 6600 - DNA, 7774 bp, Homo sapiens
cgcgctcggggccctccgcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcagctgcccatgatggggggagctttcatggactcgcccaacgaggacttcagcaccgagtactccctgtttaactcctctgccaatgtccacgcggctgccaatggccagggccagccggaagatcctcctcggtcctccaacgacgccgtcttgctatggattgccatcatagctacgctggggaacatcgtggtggtgggcgtggtgtatgccttcaccttctgaggacggcacaccctgcaccaccatggggtgaggcttggcacgtagctctgacttgctgtcggcctttggcttctcctgtgttctagaaccaggagttttgaccaggggcggcggccgtccttctggaatttctccccagcagccctgatttcaaatatcccatgttgtggtcaagctgagtcagaagacatggaagtatgggcctcctgcccctagaggcatgacggggcaaggccttcagagggcagattggggatccttgaaactacattccaggaacatgggaccagatgagacagctagttaagtttaaaacatagacatgatttgatgatcgcttgctggtggtaaataatcactcgtgtgtcttgtttttatgcaaacttatcgaacctagggcgtggggtgctggggcaagagcagccctcagaacttcagtgttcctgacccaattctggtttcacattcagtcccttggccatctagtagggccattggatgttcctagtttgactttgaaatggcacctttgccaccagacacctggtcccttccaagacccaagtgcattgggagacccagggatggggggttactggtaataggtggggtttctgggggtgttgttggtggtttttatctcctggtcggactttctcttctttttaagaagaggagaggatgtctttaagagctagatgtgccaggcagtggactcttcaggccacccacgtgagaatgctgtttcttctctgaggaatcgtggaattttaaagatgaacaagattcacatccactgaattattcaacggatgggtcagaaaggggggtgatttgcctgtggtcaccaggcaggtttgtggaggagtcggaacagaaagatgtgtcctcactctcagctcactgagctctctgccccaactaagcacttccctgaggaggttgctgagaagctgccctcaggagaatgtccaggcatcttgaaggtgggtgcgagattggcaggctgctcagatacccgtcctttacattcagtgtggataccgtgcattctcctgaagctgtgaaagtgcttctgcccaagccacttccttaaattctgaaatatcagcatctggggtcctggcaagcaaggaagcttccaagtaaaaaccagagagaagggcacacttttctttcttcattaggaaatcttattgcacaggaaccacccccacccccaccccccacaccttcccaaggcagcatcccagtgcagatagagtgggaaaggtcccagaagggggctcactcacctctaggcccagagaggctttctcctcactttatacactgcaaaaacagaagaattgtgtcaataacaccctctgtagtggagaaacttaaaaagctggttaggaagctctcgtgtatatttagagacaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatcacatctgtcactgccaccgtatatcatctgccagtgcatcagcttaaggggaggtcacgagtgcaaaagaacctgacccttgacaatgagggagaagggacatggaccacctgtctggaattcctggaatcactggcagggtggaggctgggctggggagttagccgcggtgtgcgtgaatggctctgtctccagcaagtctctctccatcaaaccccaggtctgccccataagcaagatctttaacagatggatgtctccatgagaaaacccaaggcgagaagcccagagccatggcggggttgcttgacgtcctcatggagtcactctgccccacatgctcaaatcttccctctggccccacatccctaggagggcctgacccctgtaaagatacaggaggcagctccctggcctccaaatggcccatggagatggcagtcgggagacagggttctgtgtttgctgcggtgaagggaggagaaggcaggaggaaaaaggatggcttctagccctgaagaggactccagcatcccaggcaccgggtgcttctggctgcagttttccctatggaggcccctcagcctccagccctaacataaatgtcggttaaattcagttttcaagcctctctcccttttcagtgtcagagcagtagatggtccagggcattggaggcctcgaccactctgcattgcagattacagtgacttcctcggggttgccccatcttggtctcctgtggtttcttcatcagctttttttttaccagcatctctcaaataacaatgaagatagatatgcccattagtgtctgattaaggagcaaaggctggatttctggccacagcgagctgcactctccctcctgcctcagccggggtccgtcttagcagtttggaaaggggaaaaagatgccggtcctcactgcttaagttttgtgtccaggtgccactagacttgcatgcacactaactccttacaatcaccacacagcatcatcgccccagtgcacagatgaggaaccagaggctcagaggagtgaagttgccttcctgaggtcacacagcatgaaagtgatgagctaggatttgaatctgggaagttgggctctagagccagactgtactgccttctgccacactgtactgccttctgtgactgggtggcacctccagggcacatttacacaaggccctgaatctgcagaggctgtttctcaagatgcccgtcatggtgtggcctgggccagctctggcttccacaggtccctgactgtcctcagagtggaacatgctcaacctcccgcccactgctctctctctgcccagatttcaggggtgccggtccccaaggcctgcccccttctttaagactgaactcaagtctccttggaaggccccggtgaagctcccagagactggttttcttgggatgcaggcagaaggggaccctccctggccaacacccaggagcccagcagaagcacccacacgtagaaagaggctcactacagccagaagtgcagagtcagagtcctgggaccatcttgttctgcaaggtgaccccaggctccccaggacaggggagagggatcgtcctcattcagactctagctggggcctctgtactggcttctccctgggtggggttgcctgttacatagctgtgcctcagagaaagggtcctgcattttctggaatgttctctgtgcttacccctctgtgtgcccctccattgctcctctacaagcaattaggtgattcaaaagagcaacttaggctgggtgcagtgactcacacccgtaatcccggcactttgggaggccgaggcgggcagggacaggagttcaagaccagcctggccaacatggtgaaaccctgtctctacaaaaaatacaaaaattaaccagacattgtggcatgtgcctgtaatcccagctactcaggaggctgacacaggagaattgcttgaaccaggaggcggaggctgcagtgagctgagattgtgccactgcactccagcctgggcaacagaacgagactctgtctcaaaaaaaaaaaaaaagaaaagaaaaaaaaaaagagcaacttactgctttgtgaggttgtgagtggccaccactgaaggtctttgagaagaggccagacgccgctgtagccaggcctgtcttaagaggacttgtgcttccagggacccaggcaggatgatggcgcagctcttcctactccaagccaatgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggctggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcgtaggtggtgcggtccccgggggattctggatgctggtcttttgaccgtggcggcagcctcgcgcctgcccggatggctccatccagacatttggcaaggctgtcatctgctcttgggtcctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctcccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacacctaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaactcctctgtgtctggttctcatctgtgctttatgcaaaggagatgatctactcagctttaaatggctcagccccagcgtcacctccattctgatgcttttcctgccccaccgaggcaggacaggtcccctcctccctatcccctcctgataccactctatcatcacacctgtagcaaatcaaatcacggaa

SEQ ID NO: 6601 - DNA, 1833 bp, Homo sapiens
gcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggtgcctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgcgggactgggtttcccgggcgagagactgaatcccttctcccatctctggcatccggcccccgtggagagggctgaggctggggggctgttccgtttctccacccttcgctgtgtcccgtatctcaataaagagaatctgctctcttcagccctgtgtctgtgcttgagtgggggcgagcacggggctgagactagaggtcggcctctgcctggaaagtcccgatgtctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggt

SEQ ID NO: 6602 - DNA, 571 bp, Homo sapiens
gtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggtacaaggcactatgaaatgatctagtttcgtgggtgaggggctgaagggcctatgatgcacggaggcggggaaaggatttagagataacgtggtttgaaaggcgggacctggtgcggggacgctcttgggaggagtcttctccccagccttagctggtttcatgatttctttgcgtctgtaggcaacgcggtaaaaatattgcttcggtgggtgacgcggtacagctgcccaagggcgttcgtaacgggaatgccgaagcgtgggaaaaagggagcggtggcggaagacggggatgagctcaggacaggggtttgtgaagaagtcgcaggaaccgtaggctttcgttgggtctatagttaacgccggatcgcagttggaaaccaccagcttttt

SEQ ID NO: 6603 - DNA, 1916 bp, Homo sapiens
aatttgtatgtcttattgaaaacatctttgaaaaacagtacttttggtgtggtatgtggtaggtaagactttgtaagttaagtagttgttcactgaatgttagcatcttttttttttaatgttcatatggccttttttgctgtttataaattgtataaactatgttcactatttgatcctgtcaaccaatattaggagtaaccactgcattatatttacatttgactctatgataatatgtaatattcacattttgactctctttgggagaaataaagaataaatgttagttcccaggccaaaataacagttgatactttcttctgcatcaacattgcatctgttagactggaatgaaaacaacacatattctgattaaaggctatgttttatacttttcaagtaattattttcaactttttttcctttttttttgagacagagttttgctcttgttgcccaggctggagtgcaatggcgcgatctcagctcactgcaacctccgcctcctgggttcaagcgattctgcctcagcctccttagtagttaggattacaggtgtgtgccaccacgcccaactaattttgtgtttttagtagagatgaggtttcttgttggccaggctggtcttgaactcctgacctcaggtgatccgcccgcctcggccttccaaagtgctgggattatagttgtgagccattgtgcctggcctattttcagtatttttgtttaaattttgtaaaaaggtaaaataaatgatttttgaaaatagctggagttgttttcatagagtctgtggttataggactatttaactatatattgagtaaaatctatgctatgtcaagttttattcagttgtccctagtagaatatatttctcttttaattctgtatacagtatgagtaactccagtttaaaacactggtattttaatgagtttaaattgtactgttatatattatgatacatatttttcttctggctgtggtttagtttttaaaatttttgatgtccattttaatttttagaaataaaagcttaaaaatatgggtggaagtagatttcagtttgatgattatcttggtgaaagtatagtacctgtgaaatggtggtaataatttgattctttattctattttgattgtagctccttttgtaaggagcatttgtaaaatttagttgctttagagttatacaaatccttttattaccatttattaactgtttgttgttttaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgc

SEQ ID NO: 6604 - DNA, 5692 bp, Homo sapiens
atttcctttactttatagatgtattctatacctgctatgtagataatgctctagttttccctttagtgccaactggaaaaggagagttggctttacaggggctgtggattaagagccaggcttcattccatcccagggagacaaaaagagacagaagaagttacctccagcagcaccccagaaagctgacagatattccctgtatgcaggtagtaaacagatgggagtctgtgtttgcagctatgttcagtgtaattcagcagaccttcactgggcacttgtgatgggtcaggccctgtgccagcaacaggggaagggaggatgaacaaggcatgtttccctgaccatgaggagctcttggcctgtgagctgttgggatgtccctttgtggtgttggaagctgtgcacgagcagtcaggactttggggacagaagtttagtgttagggaggcagggtaacttgctttgacagctacccaccctaagtcagatgacaggtgtaattctaggggccctgatatgcatcactgaggcagactgaggagctctccagggaagtaggcaatatttccctgaatattcctcaattccaatcaaggctgactcagttcacttatggatgaaagccagttaccctgcccactgggcagaaataacatggttgacagctgacattcagagaaaataagacagaagcagtccttaaatataaacagcagccaggtggacctggaaatttaggaagggtgatgcaggtagaggggccagcaggagccaagtctcaaaaggcacaagccagactgatgcaagggagccctcctgaggcccaacatcagagctgaagatctaaggagggcccacctccacgagacctgctgagggcttacatttggtgctgaggagcagtggttccctgggccagctgcatcacctgggaacatgtgagaagtgcatattcttgggccccaccccagacctactgaatgagaagctctggaggcaggcagtctgtgatttaatgagctttctgacacacactaaagtttgagaaccactgatgcagaggatgaggagatgacttgagctggcatcgggaagaactgactattaactaacaaggtaaaatcaatgactagtgcagtgagggtgccaaagcaaaccacccccagcccccatcctgggcctttttggctccagtttatactcactgaagcagtggtttcaaggaaccttggtcctagtccgcatccttcacctgcccttgggcatgagacaattcctgcctgcctgccccttctatcctagagagagagactgcccaggagaggctgccatgaggtcactcatccccaggaaggccacctgccaggtttctgtaagctgagcagcctcttcgagggccatattttgtggagaaacactgaaactgcagcagtgaccctggtcactaggagagctgctttctacacagcctgtatgctggtggagacacccagggcctggcagagtgtggagggggtcatttaaggacgttgccaggttgccgcagcactgctctgtttgtttgtaatgagactggggcatgcagcatcacaattcaaacactgaattgcttggggaatggatggccttccttggaagggcagtaactcattctggatgttactaaaagtagaaaacaaaaatccaaaaacaaacctacagcctcatttacaattagaatctgtctgggccttctgatttctaaagtctgtgaggctgccaggattcaccaattctcctttcccctgaggcccagcaactattgatttatagcttaaactctgtgaaggtccacagacctttgaaaggaacttgctggtactttgtcagtcgtgtacacctaactgactcctcctacgaggtacagtctcctcatacaaggggttttgagatggagagtcagagggccagggccctgggctttggggtggaaggacagaagagtagcagtctaggaaagggactagacatgtagcctaggaaaactagcaccatctgttgagttctgaagaacccagattctctcctgctcacagcctcagcagtcttttcagagtcctcctgaatggcccaaagacacccctgtttctggggaacagaagggagctggtacctctggaccattgaggcaacacctccccagaggcaggaccccgcccccatgagaacatgcagttgaatgatgtggtgcctggccaggaccttggaaaacgtggccatgtgagactagtatagatctccaactattgctgcctctgctgatatggccacctccttaaggtaagaagactaccgacttagctattgtggcaccacgggagcctagcactgcacctggcccatgacatgtgtgccacaaatgttgaattgaattgaatcccagagatcacttgacctcagtgaagggactgggtttgaagaattaagaccccccagtggagaaagcctcctccaacttccttctcggtttgtgagtcaaggtcctttgtaaaatcagatcgacgagggtggaagtgcagtgaacagaggacaacatttgtgatgcacgtgggagaaaacaggagtggggttgtttggggactaccccttcctagctatagtcagtaaatggagcccctaagcaaggagcaggggtagatgtgcctgggtgaggcctgcttgctccaccgtcgaggtcatgggcagcatcccaactgaggagagaaaaccctaatttgttaatgacccagccttgtgctgctctccagttcctttcatcagatttactgcagagcagattcatcaacatgaagttcaattcccagtagactaatgaaaagagggcaacagacttgagaagagccaaaatgcagacagtgtgtattaatcacagacaacagaaacgtgttagctttaatgtctgtttgcttttatcttgaaatgaaaatgcatctctgttacctggaccctttttactgcacatttcagaacagaaatgggacacccacacacgtattgagggtccttttccccggcaggaggagctaccagagaaatgagcccacattttgtgtgcagagagaatcaacccacaggtctcagctgcagactccagcacctctgcagagaaggcaggcaaagggatgaggaggtagcatctcctcttcagaaggattcataagggcctctgtgaggagggccttgcttgtgcctgtgggtcatggatgttaatataaaggctcatccacccttggtggcaaaagtgcatccatcctggccaatatagaacactcacatctggagcccacgcccacccacctccagctcctctacatggctgcaagagcatggctgatgtgtgggattcagaagaggtctgctcatgttcactagccaaactttaggtggtgtgatacagcaaaaagctttttttgtttttctgtttttgttttgtttttggcgtggaggagaaatttagacttgaaagtcagggctgatcactcaaaaagtaagataggagatattgagggaaaatgtgactcatagttggagaggaaacaggagagtgggtacaagtgacagcaccaggaacaaccccctcccccagatgccaaagcattgctctgtatctaaagatgcatccaagtttgcaaaaaattatgggtaaatctggccatgtgaccaaagaggcagtcaaatcaattgcttccaaagtcagagctgtttgaaggtgatcagctcttaattgaactagtcatgatgaatcaatccaactgactgcatccagtctgacctcggtggtttccataaagggttgttgatgtcctgagctggacagggtgggcaggaggttgaagaaaaccagttggtgagtatagaaaagaaattgcatgtagaagttgtttgttctcaaagaaatctgtaggtgttagagctgggtttgttatgttattgtcagggacattataatattggtaaggaggagagaatgatttggtaggggtattcgagaaatttgagtacaaaatataaattatcagagatgagtaggctatggacagctgattatatatatgtgtgtgtgtgtatatgtgtgcatatatgtgtacatatacacataccccaaagccatatacatatctataatacagaagtaagaataaagtcataagtaccagcatattttaaatccttagaagcactggttgggatgttacatgttttttcactgttgttgtttaccgttagctctcaaagcagtgggaatagtgcttggcacatagtaggagtttggtaaacatttggaaattgaagacccagcttatcactccttcatagagactcagtagtatgagtataccccaaattgaatgagccacagagaaatgcatccagccacactccctcttagctgaggagaagcctctgtgaatccacagattccatgcaatattcagccagccgcagacacaaggtctggctcccttgtcgtgagagtgaaggcatgctgcacacagtgggtttgcatgcacctagactgcatctgctgaacacccaacagctgtttctacaagctaaagttgtagcttctctctaccactgtctaaagctgtagcttgtctctactattgtctctacaccgttgcccaaacacttggtataatgctattgaatttttcacctccaggcatgattttgtaaccaatgtaaaggttctgggttcagccagtctaaaaagtctaataatttcttctctcagtccttcccttctcccttgtctggagctgccaccgccatttaaaagtgttggacgctgtttattcccagcttctcaacctcagtgtgtgtgggaaaggcctgaaagagagaggtatgttttctctcctccagagtctctgtggtgttgacacagcagagagaggagggggagcagcctcgtcttgcagaatcaccttcaatcactgctactgtctgggccattactgccagtctggccggtgtctcccacagtggatggctttgcctccagcggtggaccagtgtgtacctgacatgtatcagacttctgagctcttcaagctgcctcaaagaatgaatctttttagtctagaaaatgtgtttatttgataaatatactattgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttcccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattggtgaataaatatgattttagaatttcacagtaaa

SEQ ID NO: 6605 - DNA, 1525 bp, Homo sapiens
cgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgtaagtgcctacctccttgcttctatgcccacttatagtcagttccctagtcctcagccctgcttggtgacgaggagtggtacccgaaaaagctctagaagagagctccagtcaaaaagaaatgagagatctgggcacagagaaagtgctaactagtaaaacacaaagaaaatgaaggcgtgagtcgtagctgaatttgagagctcttcctacctccaagtacacaaaggcttctttcctgggctgagttgggtgtcagaggagagtgggtatttgggattcagggagcagggccctttcttcaaccctgtaagaacaaccttgctcctcccacagcctggcctaattcttggtcagagttgagggagacccatggtttggaggtaacttctgaccccaacctgatcctgtgattgcttgcaggccatttactgccttgtgacgttggtcttcttttactcatctgcctcattttgggcctgggtaagtatctccatcctgggaggtggatgagtgcgtagggtcagtggctggcctttgataccctcattcttgctctgcagttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggtgagcggccccagggctggggcccagatagcccaagaagcacagctacttgtaacttgaaaagggtggaagggagttgcaacttgaaaagggtggaagggcccatatgctgtctttccagctttatttctatccacaggcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctat

SEQ ID NO: 6606 - DNA, 953 bp, Homo sapiens
gccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatt

SEQ ID NO: 6607 - DNA, 4475 bp, Homo sapiens
gtcttggtaggcggtgccgtgacaagcccaaccggacggctggagagggcgagaagggcagacgggacatgcagcctcttccgcctgagccccggaagggtgatgtggctgcggcatcgccggcctcgctatgattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctc

SEQ ID NO: 6608 - DNA, 2974 bp, Homo sapiens
agtgatgtatacttgcaccccatttactccttttcaatatttcaggatacatctttgtcctgtatttctgtaccagttcacagaatttctacagcaagatccctttaaatgtatggctttccttcataggttgcaaggattactttatacaagtgctactgtaactatatcttttgtggagtacaattggtatgacatgctgtgttcatagatgaaaatgctaagtgaggcactctgaagcaagttaaagttcacagacattcttgcttgcccaccacccccccgaaccccgccatggaatcatcaaataagaaaaataagacagattttcagattggtgatggcaaagtaagacgctggtattttgcactggcgcagtccatttagttgttgaatttgttcagcatacctggatggtgagtgagttagctttatttttcattctcagcagggaaactgatagactaggcagtttggggaattttcccattgtctactgtcatgggtccatagtatttaagtttacagactacaacattgtccacagaagccatatttatccccttggagggaagggaaaggtgtgctaacttagatcataaaaacaactgaattttaaaacaaggcaaatgccacagttcaacttctccataaaaaagttaagttcatctctccattcttttgcatgcctacaatatttccatataacaactgtaaaatactcttgcctgctgcaatccaaatgttatccggatcacagttcttgctgtcatttcacaggcatgcaatgtatctatagataggtcatatcatacctgaggaagatcagagacagcaagggaacattttccccacacttgagatggaaataataacaggtcagtggctaataaaaagaaacatgtatgactttgtaaaaccctaaaagtgatgttttcaagaaatttaggtttcttttttttattttataaaaaaaatgttgacatgcaatttaattctatttcaatttaggtgctgcaacctgtactggatgtttggggatagaaagatgaatgggacatgatttgtgtgctccaatgagctcagtccagtgtaagtgtaaaagttaaagtgccatattgtttattcagagtatatgttatagtttgtgaaccttatatcatttgttaaatgaaaggtttttataaatcaacagtaatattgccatcccatgtaaaaatcctttgatattgccaggaaacaactttaaatcaccagaaagctttaacatcaaataatacttttagaaggaggggaaaagccttccacctcgacatcgagcctatgaagtattccctaaaaaagaggaactaatctgagaaaagtttacacatttttaatactctaagttgtagataatgaaattgatttaaatcaaagttaactagaataggattcatgtgtcatgaattatattgtctattgtctcataagcaacaagtgacacttattatcttggctgacaaaatcagctaccatttaatgaaccaagttaagaataactcaggtgactgataccaaaaataaatctctaatacagctgagaatccagaaacacaaataatatgttgagtaagtaataaaagtgacatttcaaattagtaaggaaaaaatggattattcaacaaatagtatgggatagcataacaatttagaagaaatataaagttagatctttcacaaaaattaattctagctagactagcagttagtcttctactttttggttactcccttttagaaattggaagctatgaagctatataccctgtccatttgaaaatgcacataagcaaagaactttacaaataggttataaagagaagctcaatctcagcaaaataagggaagtgcacattaaaacacaagaaaccatctcagatccaactaatatttagcgtgcatacaaatcaaaagctggaaagggtgtggaaaaacaggaatacattgctagtgagcatacaaattggcacagcctcttttaaagacaattgtgtatcacccattaaattttaaaagtcacataccctgtgacctaacaattccaacttttaatgtcctaaagaaacatacatgtgttcacaagatagcctgtacaatgatgtcaattgcacctttgcttgtacagtagacccccttatctgcattttcactttttgaggtttcagtcatccaaggtcaaccacaatacaaaaatattaaatggaaaattccagaaacgaacataagttttaaacttcaaacctttctgcatagtataataaaaatctctcactatccctctccatcctgcctgggacaggaatcatccctttgtccagtgtatccacaatgtatacactcattatatacccattttataatgcccattagtcatttctattatcagatcataaaaaaacatagtacatagagggtttggtattattcatggtttcaggcattcagtgagggtcttggaaaatatcctccatgatgggggagctactgtaatactatgaaattggaaaaaccaaaatactcatcaagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaactgtcaacagtagtttggtagcgtgcattagctttaactgtaatgtttgatgtttttgaatatgcatttatgtattgtttgtgtaatgacaaattaataaattagaaataaaataaaataatgtgtt

SEQ ID NO: 6609 - DNA, 424 bp, Homo sapiens
tcctgggtcaagctgagtatctccacgtttaggtgcacaaatactattttgtgaagatcttaaatttgtggtataagaacttgaaggaaatagaactgatttgttacttctaaaagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacaccagtgggctcaggagcccggggagaaaaatacatcactaatggccagttttccatatggtctgcacgggtaaagaaagt

SEQ ID NO: 6610 - DNA, 2291 bp, Homo sapiens
ggggagggggccaggcagccgttagacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattactttgaatgggtctgtcacacgcagcccaactcaactggagtcctgagaaggtgaacagaccaggatggatggccagggaactcaccagaagtccccaggcatcagaacaaggtcgaagcatcctgattagggtaccagaggcccaggcagtacttttggggtagacgaggtacagacctttggctcctcactgtcttcaagcccacaagaagcatagagcagaagaagacagaggagggcccatctggcccactacctgttcttgtaaataaagctttattgaagccaggtgctcaccttctagcacattcttcaagagttactctgaggcaagccagccgccatgtcatgaggacactcaagcagcaccatggagaggtccgatggcgaggaacagaggatccccctgccgacagccaatgaggaacaggcctcctgccaacagccgtgtaaggggtcaccttggaagccaatggcccctccctggtcaggcttttacatgactgcagtcctggccaacatcctgacggcaacctcatgagagaccttgagccagagccacccacctaagctgcttataggttcctggccctcagaaatcacatgagatcataaatgtttgctcaatttgagatatttgtgatgtagcaataaataacaaacacacttacctttcagggttattatgagaattaagagttaatacacatcaaactacaaccaaacttgctgggaccagaggctcaagaaagggcagacagggccgggtgcagtggctcatgcctgtaatcccaatactttgggaggccgaggcaggtggatcatctgaggtcaggagttcgagaccagctggccaacatggtgaaaccctgtgtctactaaaaatacaaaaattagccaggcatggtggcggacacctgtaatcccagctactcgggaggctgaggcaggcctcacttgaacctgagagctggaggctgaagtgagcagagatcatgccaccgcactccagcctgggtgacatagcgagactccgtctcaaaaaaaaaaaaaaaaaaaaaaaaagaagaaagggcagacagaaaccacagaaggaggagtggttagctaggtccaggccagatggggtcctgctcctgacgtggatggttctgggagaccaaatatgcaaatagacaatggccagaccacatattaaaatagaactctgcccccaaacctacagcaccagcccaggaagccaacgaacaacccctgcagcaatcagccccaaatggccaggacttgatggtaactgacagcttccctaattttgttcccactttcaatgcaggacaaaccggagaaagccaaatatgctcccctaaccaattacttaggatgcccctcttctaatgagcccaactgtagctttcctgcaccaccaacaggacgtacctgaagccttctcctttttccgctataaagccttcccctcggcctgcctttgagtctccatgaaaagcaagtgacagtggctgcctcccttactgtaacaagctctgaataaacagcctttgcttgctc

SEQ ID NO: 6611 - DNA, 5721 bp, Homo sapiens
cggctccctcagtctggcgtcatctaggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgtgagtaatagggacgtgcgccgccttgttggtgttgatcagtccaccaaggagaagcagctggtcgcagtggccgtacctgtaatcccagcgctttgggaggccgcggcgggaggatcgcttgagcccgggagttcgagaccagcctgggcaacatagtgagaaacccgtctctaccaaaaagaaaaaaaaaaaaaaaggaaaaaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataagttaacagtctggacacgattgattctatattctgtttaccttgctctaggctattcaaatgttatatttatttgaacactatccaatatatgttccctggcatcttcctgtcttttaaatattctctgtacgctacagttctttgtaagtaaaaataagcttaatatgtctacttagcaaacaaagtttttccagatacctataataatgaggaaaacagtataaagaatgaagtatttgaagaataacttataatttgggggatttctgagaattctacttctttgtccctaatttccgaaggtaaatgtttgttgtgaatttggaaacactagactacagaaaagcaggcactctctagcctgggaggcccactgatcttaggagggtccatatagctgcttattgcagaccttgcactagaacccaggtcttttgacacctggtgccacttttcattccattccattaattatagcccagagaataaccac

SEQ ID NO: 6612 - DNA, 2241 bp, Homo sapiens
gaaggggcgggattctgccagccgcggctgccgctggagccggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagtgcagtggtgtgatctcggctcactgcagcctccctctcctgggttcaagcaattctcctgcctcagcctcccgagtagctaggactacaggcatgcacccccacacccggctaatttttctattttagtagagatggagtttcactgtgttgcctaggctgttctagaactcctgagctccggcgatccgcccacctcggcttcccataatgctaggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctaggtaggcaaggctgcagtgctgggctcaggtagaactagaagcacctatttatggctcctccaacaaggtgggtccaaagtagtcagacttcttatgtggcagctcaggggtcccagagagaatgttccaagaaagccaagcaaagctgcaaggtttcttttgacataggcccagaagttccagaacgttacttcagctatcttcttttgatgacataagtcaataaagccaggccagaggatggggaattagaccctacctctcagtaggaaagaatttgtagccacctttaagctaccacaaaaagttattcaaaaaaaaattgtttaggccgggagcgatggctgtaatcccagcactttgggagaccgaggtgagtggatcacaaggtcaggagatcgagaccatcctgaccaacatggtgaaaccctgtctctagtaaaaatacaaaaaattagccaggcatggttgcgcgcacctatagtcccagctatcctgaggcaggggaatcactcga

SEQ ID NO: 6613 - DNA, 2189 bp, Homo sapiens
gattataattgtgagccaccacacttggtcttaagcaaatattaactccaatcactatcctaagccaaggtgtctgagcagctgagggaggaccagagtgaatgcagctagtgccacactgaacaaaccactcttgctcattccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataaacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaa

SEQ ID NO: 6614 - DNA, 724 bp, Homo sapiens
tgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtaggaacaacacattactgagaaaatattgctactgttagcattacagtggagaattacttctgttctaatcagttgaagtaaatgccagcatttttatacattattttaatggtctgtaaacttgcatcttgtgatttagggtaattttaaaagcaacctttaaaagaccttttttaaaggcctttgtgccacgctgacaaccctggcagaaaaggacatcttaagggaaatattggtaactaagctctttagaggcaataatgtatgtgacaacaaacagatatactagttggctttcatacagtctcttatattatcattttccactggggacttaaggactttatttga

SEQ ID NO: 6615 - DNA, 1061 bp, Homo sapiens
cgcggcgctccaaagctcggggagtggtggtctccctttcctggagtcatttgtgggagttagggtcttatcctgatctttcctcgtcccccgctcccccgtcctccgaggtggcagctgcgtagaagtctggaacgttttttcttagagttccagaattgagactgaagtgtacccagagacacaaagaaatacagaagtccagaatgatcaaatgagatcactacccaatgaaatgatgggccgaggagccagaagttgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtcctgcccgaggagctcagagctcaagcacagagatgtcagcctggaatcagaatcactggctaagtcttgctgcttgcttcttgctcagcctgcatatgagaagtcaaccaagcattctcttggatgcaagatccaactgcacccatgggaaatctgaacttccactttctttgagcttgtctttggttgtaataagaatccatcaaaacccatgtctggatctctctttggctgaggcagctttatttcctacagaaagagtttctctgtcctcttgttaggacaatcagcctgctgctttgggcttttccaagagcctatttttcatctgctggatgcctctttttttttttttttttttttttgcactgtgtgacatgctttaatatatatattttttatgtatccaaagaggtaatcaactttaactttcagaattcatgaatcttggtttggtggcatgaatgaaaggttatgtaaccccaccagtaactcatttggggtgcccttgaaatattaaagtttggtcc

SEQ ID NO: 6616 - DNA, 4148 bp, Homo sapiens
aaagatgtcctcccctgatgccacatcctgttccaatgatcacgccttctccagttcccttcacagccaagcttctggagagcagcttctgcacaagctgtcttctattcctctgttcccatccatgttccagtccattccaggctggctcccatcctgattgcctcacagaaactgttctttgcaggtccccagccaagtccttattgccacctccagcagcctctttctgtccccacccccttggacctgtcagcagcattcgaggcaaccgacagcacttgctgagctgctctcctgtcatggctggacacgtggtgctgggcaggcttgcctggtgaggtgtgggcaagctggactccgtcttcttcatccagtgcctctggtcttaggcctgggtgtttgtctcctctctgtgaagctctatgcagaactgtgccaaggcatcgtggacatagccatttccagtgtcttcccacccccagatgtggagcaacctcagacccagccagctgccttcatcaagctgtgacagagggcactccctgctgccttggaaaaagcacggggtcctgctccagggaatggtgaaatgactggattgctctttatccagcccacagcaggggaaagaaaggcaactcgcaaagatgagatggaagaaggcacgtgagcagaggaggcagctcccaaagagagggctgctcagggggcttcccagatgtagctctcagcagtgctgttgagacttttgaaaacaactttggtacacaaaggcagctttgtgagcagagctccttcccctctccccgggaacggcagggcactgggacctctggtcggtgcctcccacccactgcagccctagtgccttagctccatgcccggctgcagccccactgctctggactatggattggacgtcagagcatattggaggttgcctgtgtgttccccacccatcccttcggtaacactctgccacactaagctctgtacaagcatgcaccaacagtccttagttttgtgctgtgcactggcctctcggcaaaggtggtttccctcatcaccttcctgatggtgtttggtcagtcacctgtcagggtttgtgcgggttgggccccaaaacagcatatgctgctctaagtctgctctctgcatgttttagaaacaaagtggcaagtctgccctgaacctgtaagcatcaaataagcatgagagagaaaaaaacatgatatattgctttacttaataggttgaatatggtaggtctttgaaaatatgatgattcaattttctcaattttctttgctttaaccaaaattctaaatgcagttttgcctagttccctttttttttctttttttacttttttttaaacgtttgtaaaaacctctttgaggatgaggagtcagtaaaattccactccccaagtggccctgccccagacaaaggttgctttccccctttttgttctttttatgcccccaagcactttctgcagtagctagagggacaggtttccttccaggaaggattcgagttcctgtgcctgtgggtattaggagagtatatatcctgcctgaatggggaagtcttctaaaatgggaaagaagtggtttcatctccacacagtgtcttgtaaatctcaacaaatgtgtactgttagaagtggcttccgcttactggattaactaatactttataggcttttcaggaggccacatcactagcagtagggagaacaagatgtcatttgtgttcagtgtaagctgagtaaacaggcccttcctagagtgtcctggaaatcacagcaacccattgaaaactgccctccccaccagaacgtgctacgttctttcttcatgcctatgtgtgctccattcctcatttctacttggctcaagaaaacatttctgcagtcaggtgagacttttacaaaagaggagaaaatcaatgcctccttgaacatgatgagatgtgagaacttacaatgaaaaaggcaataatgatagaaattatttcttaggtacagcaatagttgataggatgtgagggtgttaccttggggtgaagtggagaaggtcccaggtgaattggctctcatggaaatttggaattacaaaataaacgtcctgggggttacccagaatacagatttaaaagtttgcctgtagagcaaaataaaacagtcagttgtagtcattaatccttgaggcccaacgcagccgatgggttggtgtttgggaaattctgagatgggagtgagatctgatcggatcctgggaagatgtatacccagttagaacgtgtagggttctgggtccctggcaagtctaggtgggcgggtgacagggaaagcatgggcatttttgtattgctgtcacatgctaacagaggtttgtaattatcttttggacccaaattatagagacattcacgagttttctagccctcacagtaacagagctaagaattcagatgtcaggaagtctgtgaatcttgatggattttctgagaaacctgactcaatggcatatataagagggaagtaagacttttaagaaaagaaaaagttatgcctcattcctcatgtggcttccaataagtatcttaggaacttatttcctttttaaaaaatattttttaaatttttaaaatttgattttaaatttcaaataaatttaaataaattttaaataaattttaaataaaattttacagagacgtggtctcactgtgttgcccaggctggattgcagtggctattcgcagttgtaatcatagcacactgcagcctcgaatttctgggcttgagcagtcctcccgtctcagcctcctgagtagctgagactacaggtgcacaccaccaagcctggctttatgtatttatttctgttcatgcggaatgattggttcagaactgttcctttcccttccatgatgtccttgacacagaaggttatgcctggctcccagtcaggcttcatacttttggtccatgtaagtgctacccgttgctgggggaggagtcatggtttatttggaaatgtcagttgcaatcatggttctgtcatttgactgcacagtatcagaggagcctgttaacctctctgtgccttagtttcttagcccatgaaagagatcattgcctgacccagggactacctcaagggcttttgatgaggacaagtgacagtaggaagatgcaagagcctttagtaccaaggttctcaacactgactacatgctggaatgactgtgaagcttttaaaaaatgttagtgcccactcttcccctgtacccccggacagttaaatcagaacctcagacagcaatatgccttgagatgccttgaaccatgcttgagaaggaaggacaaacacattattatcttggaagaattgcataaggcttatgacttaaaaaaaaaaattctttttggaaacacaagcatttctttaaggatgaccggatgttgccgtatgtatttatggcacaagcaggtgttgtctaagcagtttctctgtttgcttgtcatagcagcatttggaaactcaaacatgctttcatttacataaatagtttatgaagctttgacaacaaatgtaaacagacacgaaattataaatctgctaaatatgtattaagggtattaattattgaaagtccctttccccaaaactcaactcctatggcaattatgaactccattttaccaagaacatttaagtgcctcagcatctgtatgatatagtggagcaggtgctgacataggtaccagctgacatgatgtgtcactagctctgtgggatgattgccacatacatggaacacctgggagtgctggaaatgtactgtgatcgaagtgacaaagtgtgttttcattcacagtggaggctacatcaagcaaggggaggtccagccctcttgcaagtgtggtgagaggctctactagcaaagacatgggcaccggagtaggtcccgtgtagcatgcgggtgctgtagagaaaattcagtgacgtacatggctctggttctggacacaaaatctgtactggagaggaaatgactgctgaaataaggcgattgtatgaatatttaaaatgcctggaacactaaagtaaagtaatgatatttcaagtgtt

SEQ ID NO: 6617 - DNA, 635 bp, Homo sapiens
gtcagtacaaaagcattccctactagaaaaatagctgtgtccacagccttctggtgaggggttggttgcctggcttcagtctatttcaaaagtcagtgcatataaattgaatattaagtcatatggtgtatatggcacttaaacatcacttcctaacagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgga

SEQ ID NO: 6618 - DNA, 895 bp, Homo sapiens
atgtgtacccaacctgtaacaaacaccaaggaggtaaagtggcagagggtcttgtatgagcaacagccctttcctgataactttgtggaccggcggttcctggaagagctctggaaaaacatccatgctcggaaataccaatattgggctatggtatttgagtccagtgtggtgatcccgcagctgtgcagtgtttttgtttttctggttatctggtggtatatggatgagggtcttctggccccccaatggctttttgggactggcctggcttcttcactgattgggtatgttttgtttgatctcactgatggaggtgaagggcagaagagtgggtggacccggtgggctgacctgaagagtgccctagtcttcattactttcacttatggcttttcaccagtgctaagaccctgacagagtctgtcagcactgacaccatctatgccatgtcagtcttcatgctggtaggccacctcatcttttttaactatggtgccaatgatgcctttgtatccactgtatccagcacactatccttgaacatggccatctttgcttctggatgcttggcttccaccttccccagtccctgcatgtcttcatcatgggaacacttgccatccagatttttgtcctgtggctcatgctacagaagaaactaaaggcacggactcccaagggctatgtggtggtcacactgctttttgccttttcggtcttggaaggcctactgcctattagtgctgtgggagccgtactctttgcccttctgttgatttctatctcatgtctctgtccattttacctcattcgcctgcagctttttaaagaaaatattcagaggccttgggatgaagctgaaatcaaggaagacttgtctaggttcctcagc

SEQ ID NO: 6619 - DNA, 4671 bp, Homo sapiens
gttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtct

SEQ ID NO: 6620 - DNA, 1687 bp, Homo sapiens
acacggaccccacgagcgcggcggcggcgacagcagcgggccaggcaagagcacaacatggcggcgggcaggacggaccgagctacagcagcggccgcgcgaggaagtgaggtctctggcgaaggcgggaagcgctgcccctccccccgccgccgcttccctatcaccctcgcacagaaactcccgcacactcacacacctctgctcaggagtccaggaagagcaggagccgcccccgcgctcctacggagtcgggcaatgcagaggcccaggcgcggcggaggggagggggaagtgtgcgtcacggagaacggagcgcgcgcgaagcgggggcacaagcaagatggcggccacgccgtttgcaccgtttccccttttcccttccccctcccttggcgcctggactcccagtatcgtgcggtgcgcagaagctgtgctccttgaggtctcgcgagaattgggaaggggcgacgacagagggaggcggaatgagatctgagagttttaaccccgccccctttcgggagctcgagatctgagttttgaccccgccccctttcgggggatccggaggcgctgcccagtgacctccaccaccctgcctatccttgtggatctccttggtgcgagcttgaattttaggaaataagtaggtgtgtgcgcgtgcccttgagttttaggaactaagtaggggcgtgtgtgtgtatttgtgtttttaatttggggagaaagaactgggggatgaaggtcgacatggcgttccagattaagcatgccgttcaagtagacagctactggcaccttaaattcataaaagagcatttagcaccaaactgtaaagtgatgtcctctagaataaagaacagtacttaccaagaatagttagcttgtaaccttacgtcgacatagttgttcttatttgaatgcagattttaaagttttatcacgcagttggaaaccacagctactatgagcatggattttttcatacttatctctttcatttccgtgaccacttggtccaaaggcatcaggattgtatccattttacaaatgataaaactgaagctcaaaaaggttaagtaacttgatctaagtccccacagctagtaagtgtcaaaaccccatccgaataacttcaaaacctgtaggtatagtcatcaaatgtgtcttgaatggaattacctacagtgagagttagtgcattaggtaacaagcgcagagaggaatgactgcctctgctgatggtaaccttgaattttacaaatgacactggagcctttctgagactagtgttgcatgggtcctcaataaaatcacactgttgttactcacttcctttgggtttataaccctggtgataaagtaattgagaatagtggagtaaaccctcgacttgaattcaggaaaattgttttcaaatccagtttcaataaatctcacatcaggcactctatttgatgaatgaatgaacaaaacctaactataagacacttgacttcagggagtctcaattccttcatctgtaaaaagatctaattcctaacttttggtaatgttggggagagtgaatgaaataatgtgagagtgcttcgtaaattgcaaaagtgttataaagaagttactggtaagagctacgagtgtctcgctgcactctagcatgggcgacagtgcgaggccctgtctc

SEQ ID NO: 6621 - DNA, 2418 bp, Homo sapiens
gcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagtt

SEQ ID NO: 6622 - DNA, 1209 bp, Homo sapiens
gagcgccgctgcctggtctggagaaccccgcggagctggcctggcccgacccggcccggcccggtccgcggcgcggtggtcgagggcccgcggcgccttctgggagcgggagggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaa

SEQ ID NO: 6623 - DNA, 2069 bp, Homo sapiens
acagacggtctttacaagcgactcgtgggcgtcaatactgggctgagtttgtggcgcgcttagtgatgggatggccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaagtccagattcctaagatgaggacacagcatcctgggccactgtcactaatacaaatttgcctctggagggactctacggaagataattcccctgaaatttggagagttgaattaagctaggactgattctggctggaatttgtggtggctacgtaccctagagggcctcaaggaaacccacggttcaagacagccctgacagattctggagtctagaacagaaatggatttgaacatgggcaaggccaaccacccagttcacggcctgtgtacagcaaagattacgttacagcctgagagctaagcctggaagctctttcatccatccgtttgtccatctatccatccatctgctcatccatccctccatctgctcaacaaacgttagagaatcaatccttgtgtcagatactggggctgccctcaaggagcttttatagagttcagggtacagccaggtgggggagacagatcactataaaaacctaccactataatccaaaggacaagagcaaaaatagtaaagaggagagaagacccaaatttgcctggtgggtcagagagggctttctagaagaggtaaaaaatcttcggggctatcacttcaccttgcctggtggataaagggaggactttccagatacagtggacagaatgtgcagaggcaggagccatgagtggcagaggcaggggagggactgcagagacaggttggagccaaagcacgtggcactggagccatagccaaaggaacaaactgtgagacctgggacttgaatttggaggtggtgaaaagtgacaaggtcttcacagaagagtgattttttcaacttagggaaggctgaccccagaccaatgctgccaaagtgtggtctgtgggctgttagcagttcgtgacgatgtaagtacaggaattgagattaagcatttagaacacctacagcactttgatagtcattttactttttaaattttgagctggcattttatatgcctggtttttttttgtttttgtttttttattttttttgagacagtctcgctctgtcgcccaggctggagtgcagtggcgcgatctctgctcactgcaagctccgcctcccgggttcacgccattctcctgcctcatcctcccaagtagctgggactgcaggcgcctgccgcctcgcccagctaattttttgtatttttaatagagacggggtttcaccatgttagccaggatggtctcaatctcctgatctcgtgatctgcccgccttggcctcccaaaatgctgggattacaggtgtgagccaccacgcccagccttattctctttttctaatagttgcactttatcatattttacaaatgtgtgagtctgctatggattagaaattaataagagattttgccacagatagtttgagaagcccagcactgccactcaacaaatgctggtgcattcagatggtgaaatattctgcagctattaaaggagttaaaactgcctccacttacctggaggcccatctgtgacacctttttaggttaaaaggaaaagaaaaacttgcttaggactgaatatgagcggttgcaatttgtaacaatgatgtatatatacatatacattttcatgtatttgtatgaacataaaagtattgaaggatattcatcaaactgctaaaagggttgcttcagagtaacggactcggagaaggcagattaattttctcttaatggaactctgtattgtatcacttgtaaaaataagcatgtgttatctttatgataaaaaagtaaaaacctaaaaaag

SEQ ID NO: 6624 - DNA, 1786 bp, Homo sapiens
attagacacttgccatctttgctcattttcaagttctctgtttacaaaactattaagaaggtgtgaaatgcagccaaacttcccagtttatggggaatgtctgatgattacatttcctacatgttcattgttcgcacatgaagaaatttggcagctgtgagattataaagttcagagtatccaaatctaaccctcactgggattttggttccctgctttctgccaccaccatctcacctccttttgtaactctttttgtggtaaatgctgtgttggcatttcttaaggttagtgatccttaaattttcttgtttttttttccatttatcagatgctatgaataaatcatagattaaaagttcacctgatacagagtcttgtcttcaggccataacatacccaaactgttaagatttcttacgtgtgaaattctcaataaagaggttttatattggtgccattattgggagaggagggcagtagtggtagccaatctaaatgttataattatttcagaattactctgccagaaagttatgatcatacatagaagagtttgtagctaactttgaaagtagtggaaagtggttttcatgtattgtttgggttaatttaattttgattatatttggtttttagttcaggtaatttttttgttgaaaacttcaaatgacaatttcttcatggttactaaagatcactcatgtggagtagtttcagatttttttctgaatacatgtattacttttagagatgtaaagatgtgaaattactaagagagaaacccatgtgatttgtttagtggatcaaaagtcggtagctcctttgatcctaagtgccactgatagttaaatagatactgaagctatgggcaggctggattgataagaaaaaaggagacagagaaatgggaaattgggaaagaactgtgcaaataggaaaaggagagagcaacagaacagaattagtaccacagtgccgtaagtgccacctcaggtacttccatctcccatctcctgaagaattcagtaacagtttgcaaatggtcaacacaatcatttagtgatcctgtttgatattttcaatactttctgtgtatttcttgtctgttttcaaaatgatgatgctgatagtttttattgccctgaaggttattctgaagtttagcataattttatttgttcagtaaattatttgaataaaagttgtatgaatgaaaattctggtcatcattatttttggtgattatcctgcagtgggaatagaggatttataattttaaactctgtcctttgtgtttcattcacaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgctattaatgatgccttcagtgtatattcctctgttgttcctaatgctcaaaatcaagggacctctgaaggtgtacttggctaaatgtaagacatctggcatcatttgcagcactgtaacaccttcagtctcagttgtgcaattacttctgtttctttagtcagggtctttgcagattctaaagttatacatgaatacatcaaagtggacaaattttgttaagatcccatttaatatttgaaaaaatcagtagcacaaatatattttgattgtcacttacaaaataaaatacatttacagtc

SEQ ID NO: 6625 - DNA, 2421 bp, Homo sapiens
atgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccctactcagcaattggttttggtttccaaatgacttctgcatttgtaaagataacagagtggtggggtcaaagtttatcttgtgtttagatctcttcaagactgcttaagcaaaaacaaaaatcccttggaacctatcgtttgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatcttattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcttgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttcctttt

SEQ ID NO: 6626 - DNA, 2944 bp, Homo sapiens
acgccgaaggtagcgctcacatccgcgccttccgggcctggcgcccacgtgcggagtccccgggttaggaaaggccgcgcatccggaggccacgcagagcctcggggcttgcgcagaggggctgcggtgagtcctgaccctgagtgggggtcacggggctcgttgctcgctgaagtgaacacggttgcagctgtgcacagtggcggagggagaggatgagggactctgacccaaggttatgtggcagtgaggggcaagcagaaatgggggcctccggaccccaccccgagacagggctgctggccgctgcactatgctgaatatagcccaaattcttacatgggtcgtccccggggaatgctcatttttcaggctccagagcttgagagaaagtgcgaacccggtccctgagcaggtctgattcccatggccccttcgccatctgctctgcaccgaaattggattctcctacgcagaggagaaggtggagaagattctccgtcttccggagggtagctactgccggtagctccgatttccttcggatcccctttcaagggcaagcagaaggaaatcagtttctccaaagaaagtggcccggctgagtaagtgggaacaaggtggttggactgaggcacgggatcctttagctccgttgctcttctaatcccgtggccctgggcaccgccacttcctcctctgaactgctggaataatcacttctgactagcagagttactgggagccgctgtttgtcagtgttcacattctgactttagcaggagatggagcgagcgaaggagtgaagcccttgtttgtgaacagtgattgtttcccggatgacagccagatgccgggcagggccacgcagatcttagctggagcctacaggtacaagtgagagccaccccctttgacgtaactggactggcatttacagaactcatgtacagcccactctcaggaacaccagccaggaaccgtgacatggaggagaggaattgggaggaaccgaggggtcatcaaaggctggttgggtttcagccgagcaagtctgaggcccctttcccgcgccctctggtggaaagtgttcgcttttctgtccacccatgtgaaggattcaccccgaccctcctcaggtggcctttactttgcaggagcaaagcaagttggatgaggagatacatgtatgtggcacacagctttcttcacttagcaacacgtcagatgcagcgtagatgtgcggatgaaaccaccattgcaaaattatcactgagacagtcagagaaacctgacatggctgactccatgttgcttttagcctcacaggctggctctcttagctcattcctaagcatgggcctgaaactgccattgcaaaatcgtaactgagacagcaaaagagacttgacctaaccaactccatcttgcttctaacctccaagctgtccttgttcattcctgggtgtaggctgaactaactttgggaggaacttaatttatagtttaaaacaaagacgataagacgataacagccctttctcaaaacaaacatccttcctgactggggactagactgcctttgtaggattaacaaattagccacaagatcagaaattatagtttaggagtcatgcagctggaggctctaagattgtgaccctccctaaaccgctcagtgcttgagatgttttacagaccctgcacttaatggatcagctggcaccacccagatggataaactggctcatgtgatcttgtggcccccacccaggaactgactcagtgcaagaagacaacttcaattccctatgatttaatgtcctaccgaatcaatcagcactcctgacacactggcttcccctcacccaccaaattgtccttaaaacctctgatctccaaatgcttgaggagactgatttgagtaataataaaacaaggctcctgcacagccggctctgcgcgaattactctttctctactgcagttctcctgtcatgataaatcggctccatctaggcagccagcaaggtgaacccactgggtggttacaggccacgctaagttcgggagaaatttagtttatggtttaaatgataacagcccttccccaaaactaaactgccctggtaaaactaatgaaaggccgccaagttaggaggatgacaggggcctgaattctactgagccgtaagcgtaattaccggccattattccagaggacacaagatttgcaacttgcctaattactcctgcaaagaacatcgctactgtagcacctgagaatggccttttgagatgtgttttcaggcttttgcacttctgacaactgatggctgcacttggactcgccagccggtcccgcgtccccaccagaagcagagtaagcacaagaggacagctccgactccctaggatttcagctctgaccagtcgcacgcctggctcactggcttccccacacccaccaagttgttcttaaaaactctgctgcccgaatgctcagggagagtgatttgagtaataatgaaactgttgtctcctgcacagtcggctctgcgtgaattactctttctctattgcaattccgctctcttgagaaatcggctctgtccaggcagcagcaaggtgaagccactgggcggttacactgatatgattccccctttgcagtttttactctcttggtgctgcaaacagttcctcactgaggacccttgtacacgtatcactgtgagcatgaatccgaatttctttaggagacatacatactagtgggtatgtgcatgttatgtaatttctcttagcactgtttcctcactcatcaaataaggatcaagtagttctcaccacacagggttattttagaaataatttagtatacataatatacaatgcaataacaagtactgatgtctacttcttttaggttatatgataatac

SEQ ID NO: 6627 - DNA, 2791 bp, Homo sapiens
ggtcatcgtgacaggcatgcctcacaccaagacggactatcaagacctgagccgacctgacttacataaatgacaaacactagtgctttacaaaggtggctggagttctccatcttctaaaatcaacatccaatccccttcagtcagcatcttcagtattcccttgaggactggaaaaccaaagcagctacgtccatctgtaacgcacccgcaccggacaggcacgagatgtcacgtccacctggcaccatccaaagagggtaaattggagaaatcacacctttcaaatgttaatctgacactgtaaacagcagttgagttctcatttacatgggcaaagaaagcactttaaactattttcacaactttcctacggaagaaaaggaaacgattcagacggttaatggctaagttttaaacaaatgctctgcatcactacttggttaagaaataatacaatttttgcccttgtgtccctttttcttcttggattttgttgtcctctgaccaaactgaggggtgggaagtgcagatggtggactagaaaggtcatctgtatagtaggcaaatctctgtggccggggttgagggattggttgtccaagaaaatatccttcttcttccgagtcggaagaggaggaggaggaagaacaccaggaatcatcatcctcgccgtagagtcccagaaaccgattcattcctgggttctgcaggccataatcggaagtggcatgggcgtactgtccgtagagatcagcattctggatgtatgcttggatctcccgggcacttttattctgtataaatttctcatagttatcgggggtgtacagccgcagtctgtccttgggagagtattttctttctgtaacaagattcagggcattgtcggagcgggactttctacttctccggcggcggtggtgatgagacctggatcccctctcttcaaaattgtagacgcgtctccgagtcctttcactcatcggaggctgccggatttcaatgtcatagttcccattgtcaatgacatcatcagaaaacttgacctgctggggtctggattgagacttggaccttctgagcactggcagatgtactggcttctcttcaggcaggattttctctggacacaactctgaacttagactctttaaggactctgcactcctgtgcagcatggaagagttcaaagttcccatattgctcatcttctcacaatcttctgtttccatctcctcaaaattttgcagagaatacaatgatggccttggcttgttttctccatccaccgaagcccctagaagagaggccaaaacaagatgtgcttctcaatcatcctaatattcgacagtacttaaaaatatccagtgctcactggctcgaatatccatctcattgggctgtggctgaaagaggcttttatcaccaaacttgaggaggagctgcgtcatataatcttcatgatcagcccattcttcagggtcttctggagtttcctgctctactctgcctttccaaaattcttcactggcaaaacttgttccttgtctggagagactcagatcatccaattttcgagaaagggtgtcatcagcattgcctgagaggccaggaaacttgtagttcagagcaggcgataagaggagagactgtctacactgatctgctgaccggctgctcttgcccattcggacacttcttcgggagtctcttgatcgagctgactgaaatgcagagtcggaagaatcagaggcatggacgtcttcaccaagactgcacgtttttgagcagtaaatctgaccctgtttgggaaggaagggacatcccaacaaagaggctttacactgggcacaagaaaagcaggcttccgtggcgtgccagtgctgcccgtcataggtcatctgtgcatggtccacacctgttttgaaaaggatagaataaataacaggttatggtttaatgcctgaaacaaggtataaggaagaaacgaagaaaataaataaagattatgggtatgggggagctgtgtgggtgacacagatataattaatcctcattctttgtggattctgtatttgtgagtgtgcctactcataaaaatttattcacaactcccaaactaatattcgcaacagtttcatggtcattcgcagatgtgcagagtggtaaaaatacgaactgaaccaacatgcactgatccaggagatgctcagctttttgtttcagctctcatactgtagacaagtgtcctatttctggtctatctactgccgcgttttctgcatttttgtgctctttgttggtgagtttactgtttaaaatggcccccaagtgtaatgctgataatgctgaaatgctgtcatgttgctaagggcaagaaggctgtgatgtgccttacagagaaaagacatgtattacgtaagctcctaatcttgagtacggtaccactggctgtgagttcaatattaatgcatcaacaatgtacattcaataaggcagtggctttaagcaaaaacacacgtgaaacaaggttatgtattgatgggttgatgaaactgctgtgaccagaggctcacaggaacctaaccctgtattcccccatgagcaatggttcagtgttcactaatccagtgtttgcagtaacgtcacagaacacaactactgcaagtaacaagaatcaactctctgttcatttgtcaaagctcatcagctggaacatttaagatctgtacatttcattgtatgtaaattatatctcaactttaaaaaacagaaaaagaaaaaataa

SEQ ID NO: 6628 - DNA, 573 bp, Homo sapiens
acaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggac

SEQ ID NO: 6629 - DNA, 471 bp, Homo sapiens
gacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcgtagagacggggtttcatgtgttagccaggatggtctcgatctcctgacctcgtgatccgcctgtcttggcctcccaaagtgctgggattacagacgtgagccaccatgcccagcctcagtcaccttcttaacccctgacaacagcattctccgccttaatcttcagtttattttcaactttaattttatcagtttttaaagtaggtaatgtatgcacagggaacagaggattcaag

SEQ ID NO: 6630 - DNA, 743 bp, Homo sapiens
aagcagcgggaggggagccgggcgatgctccctgggttcccggtgtctgggagccaccggagtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgagatgacggtcgaaccaaacccattccaaagaagggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctgg

SEQ ID NO: 6631 - DNA, 670 bp, Homo sapiens
cgcgcccgttgggcactgggggacgcgggcgcgtcaggtgaagactgggggctgcaggcgcgctaggagaactatgccatttttgggtcaggactggagatctcctggatggagttggattaagacagaagatggctggaagaattgtgaatcttgtagtcagaaacttgaaagagagaataaccattgtaacatcagtcacagcattatcttaaatagcgaagatggagaaatactcaataatgaagagcatgaatatgcatccaaaaaaagaaaaaggaccattttagaaatgacacaaatactcaaagtttttatcatgaaaaatggatctatgtccataaagaaagcacaaaagaaaggcatggctattgcaccttgggagaaacctttaatcggttagacttctcaagtgcaattcaagatacccgaaggttcaattatgtggtcaaactgcaggacaaattcgagcatcttaaaatgattcaacaggaggagataaggaagctcgaggaagagaaccaaaccaatgcagaccaaaccaatgcagaactcctatgtgctgatggtggtcttacatttccctaagtttctgccgactaaactgtgcacacgttctcgggacctcctgaagctgcgtcacaggcactaatcaaagaacacaaccaag

SEQ ID NO: 6632 - DNA, 569 bp, Homo sapiens
agtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggctgatcagctgaccgaagaacagattgctggtaagttgacaactccaaggagtccccagaaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtaaaactaaggatgcccacatgttaaactctggagaatttgaccatgtttcacaatgtgcaaagtttgcgtatgattaattgtactgagcctgctactcagcggtttagtttacaattcttatgccatgggtctttcagtaatct

SEQ ID NO: 6633 - DNA, 451 bp, Homo sapiens
agttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttc

SEQ ID NO: 6634 - DNA, 2506 bp, Homo sapiens
gcagagcggagggctgctggtggtcagcaaaggtgggtcgagggaggggcctcggccactgcctcaaggagggccttgctgaacttggtggcccagcccaggccctctctctggcttgtcagtctcatcacagcccctccgccgcaatgtggcctggttctgcgtgtctgctgggctgagtggggctgtggcagaacagctcactcatctgggtagccgggtgggggatatggctggccagggctgccctaccctccctcctcctggtatgtggctgtgaggtgcaggcggcctccggggtgccgtgactgcctgcccgctgctacaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcca

SEQ ID NO: 6635 - DNA, 392 bp, Homo sapiens
tccaagtaggaaggaacatttgaaatgagctttgaagaagaggaggactaacagatgggaaaattataatatttctcagctagcagagatttaattttcataaattagaatcatgaactcagagcctaattaagcatcctaataaaatcgtgctacatacctccaatccacatctaagtcttcactcacactggagtcatcctccaggttattgttaccatccaacatgaaagctggctgtgcaaattcattggcaggttcatttccctcatcactgctgctttcattgacttcattgtactgtaaccaaggaatttctccctcttccaaggatgtctgttccctagtacaaacattttaaaggaagaaaaaaatattattttaaaacatac

SEQ ID NO: 6636 - DNA, 587 bp, Homo sapiens
gaagtggtgaccggagggaagccaagtgcactcaaaccctcgggtgagtcatcaccgccgggtctttcacagctgctgaaagtgagcaacagtgatgaaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtg

SEQ ID NO: 6637 - DNA, 576 bp, Homo sapiens
gttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctgggagcagtggtttcatcctgtttcccatgagaaagacctgtggggggcacgttgaggccctggaatttctaggaccatctttagctaatcgcgatcatctcagaggccgccctgagttcagttttctttcgtataatatagtaaattgtcggaacggaatctccactccgcgaaagcctcaaaacacacgtcccataaacactgtttaggttctctgcagttgtgcaaaatcttaacacaaaatccattttgtaataaagtgctggatatttgcatgtaa

SEQ ID NO: 6638 - DNA, 710 bp, Homo sapiens
atgccgggatgggtccaggctcctgtgtggactcgatatatcagagcaacccaatcttgccgggatcaaccctaaagggaccgggctacggggccaggaattgaagtgatgggttcaaagaggtagagttagccgggggtggagttaatgaggtctcttccctctttggggctcgacggagggaggaagctctgcttgaagcacatggggctggcccaccctgtagtcagaggtagcaagtaatgaggagtcctcctggagtgcctcagctttagctgggtaaggtagggcgttgtgccattgtggtcaaataacattgcacgttctgaactgtttctttactaggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttca

SEQ ID NO: 6639 - DNA, 692 bp, Homo sapiens
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgactgagtctcgctccgtcgtccaggctggagtgcagtagcgcagtctcagcttactgcaacctccacctctcgggatcaagcagttctcctgcctcaccctcccgagtagctgggattacagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaag

SEQ ID NO: 6640 - DNA, 622 bp, Homo sapiens
gtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccagacccctacgttgaaaacatactttaaataaatgttcttgttattgagagaaaagatttctgctccaggggaggaatatgtcagttgtctgagttacgggacttgggttgggtcatgaacatgagaaagttcattggctgagtttctaatagctcgcatagtgccttcaacttcataggtacttacacaggctattgaactgaattttgagtggaaagtggggtaagaggtgggaatgaacaatatggtttggaagaaccagaggatggaaggcattaagttggctaaggcacttac

SEQ ID NO: 6641 - DNA, 836 bp, Homo sapiens
ctcgaacgggatggcagaggaggtgaggagggaggaagcgtccggagtggggcgggcccggactccgacccccggggcgcttcgagccccccagctggtcaccgaggcaccgccgcttcacccaggtgagcaccctgatgaaggccacggtcctgatgcggcagcctgggcgggtgcaggagatcgtgggcgccctccgcaagggcggcggagaccggttacaggtacctctggggcgtgcgggggccggccgggctgggggcggctggagaggcttcctgcccattgggccttcccgctttgctctgccgcggacccctcctagctctctgccccaagaaatggccgggagcttgaaggagagcgggttggttcgcctgtcctaaaacccaaatttcagatttctcaatatggtcatgctgcttcctctaattggacagaaggcgcccacaccagtacctagggccttatcctccccaagccagcggctccccagtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattcc

SEQ ID NO: 6642 - DNA, 980 bp, Homo sapiens
gggaggcggcggcgctgtggtccgtgggtccgccggtccgtgggtctgcccggccgcccggccccgccctgccccccggggcggctcggctccatggcccgcggcggcggcggcggcggcggcggcgggaggcgacccgggggccgcggtggccgctgaccgggcggcgggaggcggcggggccgggccatgggggacggaaccgtccgcagccgccggagccgggagccctgcccaagtcggagcggcgtcccctgctgagccccgagcgccgggtgagaggagggcgcgcgcggcccccacccagggccccgagattccagacccagccccgcgaggggcaccccgagcgcggccccgagatcccaacccaggagccggccagcagccggatgcccgggcccactgggcgggccagtggccgcctgcgggatgagcagactgctgggggggacgctggagcgcgtctgcaaggctgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggcccaacgccaccgcctctagctccgggctccctgaggtccccagtgccctgcccggtcccacggctcccacgctgccaccctgtcctgactcgccacctggtcttgtgggcagactgctgatcgagttcacctcacccatgcccctggagcgggtgcagagggagaacccaggcgtgctcatgggcggccgatacacaccgcccgactgcaccccagcccagacggtggcggtcatcatcccctttagacaccgggaacaccacctgcgctactggctccactatctacaccccatcttgaggcggcagcggctgcgctacggcgtctatgtcatcaacca

SEQ ID NO: 6643 - DNA, 519 bp, Homo sapiens
tgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaa

SEQ ID NO: 6644 - DNA, 2884 bp, Homo sapiens
atgggtgaacaggctgtattagggccaaaatcaaatgctgattcagactttagacaaagggccctggcctattttgagcggttaaagatttccccagatacctggcaggtgtgtgcacagaggctgtagcccagaggacatatagtgatgaacatgtaaagtttttctgctttcaagtgctggaacattaagttaaatacaaatactcagaactaaccacggttcaacaacaactaattagggagacgcgcatatcatggctgcaagctcagatgctgaatccccaaccagagaagacctttatacgaaataaagccgcccaagtcttcgccttgctttttgttacagaatatctcactaagtggcccaagtatttttgtttacattctctcagtagtggacctaaatccaaggggagtagatgtgtgcctgcgaatcctcatggctatcgattcagagttggtggatcgtgatgtggtgcatacgtcagaggaggctcgtaggaatactctcattaaagataccatgagggaacagtgcattccaaatctggtggaatgatggtaccaaatattacaaaattatcagtatactaattctgaagtgaccgtcagtgctttgaagtagttggggcttacgtctcttggatagacttaccccttatagccaatgataggtttataagtgtgctgctaggtcatatgtcaataggagttctacgggaagaagcatgtgactgtttatttgaagttgtaaataaaggaatggaccctgtcgataaaatgaaactagtagaatctttgtgccaaggattacagtctgctgggtctttcagcattgaccaggaagaagatgttgacttcctggccagattttctaagctggtaaatggaatgggacagtaattgattgatagttggagtaaattaattaagaatgcggatattaagaatgctcaagaggcactacaagctattgaaacaaaagtggcactgatgttgcagctactaattcatgaggaagatgatatttctcctaatattataggattttgttattattatcttcatatttggaaacagcttacagtgctcttggatcagcaaaaagctaatgtagaggcaatcatgttggccgttatgaaaaaattgacttacgatgaagaatataacttcgaaaatgagggtgaagatgaagccatgtttgtagaatatagaaaacaactgaagttactgttggacaggcttgctcaagtttcaccagagttactggtggcctctgttcacagcgtttttagttctacactgcaggattggcagactacatggtttatggaagttgaagtagcaataagattgctgtatatgttggcagaagctcttctagtatctcacggtgttccatttgcaggtgatgtttcaaaagccagtgctttgcaggatatgatgagaattctggtaacatcaagagtcagttcctatcagcatacatctgtgacgttggagttcttcaaaaatgttgttagatatgaaaagtttttcacagttgaacctcagcacattccacgtgtactaatggctttcttagatcacagaagtctgcggcattccagtgcaaaagttcggagcaggatggcttacctgttttctagatttgtcaaatctctcaataagcaaatgaatcctctcactgaggatattttgaatagaatacaagatttattagagctttctccacctgagaatggccaccagtctttactgggcagcgatgatcaactttttatttatgagacagctggagtgctgactgttaatagtgaatacctggcagaaaggaaacaagccttggtgaggaatctgttgactccactaatggagaagtttaaaattctgttagaatagttgatgctggcacaagatgaagataggcaagcctctctagcagactgtctcaaccatgctgttggatttgcaagtccaaccagtaaagctttcagcaacaagcagactataaaacaatgtggctgttctgaagtttgtctggactgtttacagacattcctgccagccctcagttgtcccttacaaaaggatattctcagaagtggagtccgtactttccttcatcgaatggttatttgcctgggggaagaagtttttccgttcatcccagctgcttcagaacgtatgctcaaagattgtgaagcagaagacctccaggagttcattcttcttatcaaccagattacggccaaattcaagagacaggtatctccgtttttacaacagatgttcatgcccctgcttcatgcaatttttgaagtgctgctccagccagcggaagaaaatgactagtctgctgctttagagaagcagatgttgtggaggagttactttgctttcctgcaaacagtcacaggcagtgggatgagtgaagttatagcaaatcaagctgcacaaaatgtagagtgctggttactgttacccaaggagcagttgaatatccagatccaattgcacagaaaacatgttttatcatcctctcaaagttggtggaactctggagaggtaaagatggaccagtgggatttgctgattttgtttataagcacattgtcccctcatgtttcctagcacctttaaaacaaacctttgacctggcagatgcacaaacagtattggctttatctgagtgtgcagtgacactgaaaacaattcatctcaaatggggcccagaatgtgttcagtatcttcaacaagaatacctgccctccttgcaagtagctccagaaataattcaggagttttgtcaagcgcttcagcagcctgatgctaaagttttaaaaaattacttaaaggtgttcttccagagagcaaagccc

SEQ ID NO: 6645 - DNA, 552 bp, Homo sapiens
tgaaaagttctggaaatggatggtggcggttgcatgacattatagatgtactttactcaacgctgttgaaacgtagttaaaatggcagattttgtgttgtatctgttttaacacacacataaaaaaggtgccaagcctggcatccgccttccctgccatctcgaggcgtgtcctctgagctctgctgctgcctcctgctcctgcctgctttgtccagctcatttgttgaccgactccaggcttccaggcttggctgtgtgggtcctgaccattcttggcaactctctcctcagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgaca

SEQ ID NO: 6646 - DNA, 1761 bp, Homo sapiens; identical to SEQ ID NO: 3448

SEQ ID NO: 6647 - DNA, 3647 bp, Homo sapiens
gcagagcggaggagcagcagctgccaccggccggaagcctgctggctcggccgagaacaatggccgcctgtcactgtggacagctgtctcccaggctaaggcaaggctgcgctcccagggaatgcgggcagggagccagggcggagggcagaggacgagagcgaggaggagagcgcgggcacccactgatgctggcggcctcgggtattcgctttctctctcttctcccaccttgttccttttccccggatgcacgcatgcactagtaatgccgaatttagaacaacagggaaaggaaaggaaatggcaaaggaagggaaaggaaatggccgacaggaaatggcaaggaagggaaaatccactgcaactctgctgcctgctggcctgtccagggacaactattcagctgggtgggacgttgctacccccttgtggcacccctgctgcagcctgcgattcttacgccctgtatttctggtctaacatcaaccaacactttggcgaaatataataaaatgaaattactaggagaatgaaagaaagtcacatgaaataaaagccctgctttttaatgattatatcctctgtgaaatggatctgcagccctctccatttctgggttcccctggccacaccatgcttatggctgtcccaggagcaggctgacagacaagcttccaccagcatctaaccatggggctcatggacaccgtagagcgtctccacccaacagaatcctgacttgggggcagctgaggcagggggcccgagcgttgaggggaccacgctgctgccccgagacctgctggcatgccacctggccaaccctgacttcgcctgcccgggcgcatgttaactgagttacaacactgagggcacttgaacctggctgcatgaccagagatcgatcacctgtgagatcctctgtgaaacgggataagcatctttaatttcctgggctgttctggaacttcagtcagacaggacacaggagggtgtctgcaccacccacccctgcctcgtgggctgactgggaactatatgacctgtggagggctgtgaccgccaccctccacctcactggggccgcaagccttctctgctccttgattctgctgccgttgtgagcgagggccccagcacccttagggaccccaatcaatgggcttcccacaatgtcgtcaccctttgttgcctgctaagcagccctggggccacctcagaagaaacagaactcacaggtcacaggggccttttcctcctcgtcatcgtcctcctcctcttcttcttcctccctgggcaacttcctgaattcggaaaggtggggttttgctatgttgtccaggctggtcttgaactcctgccctcaagtgatcctcccatctcagcctcccaaagccctgggataatggcgtgagccgccacacctggccgcctttggtctgtttgaagagggacatggcatgatcagatggggcttttaggcctctctgaccctggtgtggagggtgggctggcaagaaggggacgactgtctaaaggagagagtctaagacctgggctgggcagggccatggtgacaaacaggagcagacagagtcgggcagtataaatggaggggcagggacagtgttgaagtttctattctgagcaactagaaggctcgtggtacagttaattaccctgatggggatggaagagtcaggcaggggatgggcaatgggctctgtttccacagcgacttgtgttccacggaggtcaagaggcctgagggcctgcaagaacatggtctgggcaggagatggagctgcggaatgaatgaggatagggggctgagtcccacagggccagagcatggctagcaaagtggggatgactccaggagtggccttctgggtgccacgaaggaaatgttttaagaagtgagattgggtcactgctttcaatgtcatagaacagagctgagcagttgaggaggcgtagtgggtagaaagggaggtcgcagcaggctgaaagcaaaccgacaggagggttagcgtcttttagcaggtaggcagggcagaagagagccacggggcagatcagggaaagaaacactgaagccatctgtggctgagaaggagggcagtggggaggagtgtctaaaattctgagccatccctggcttttctgggcagaaggggtcgctccctcagtggccctatggcctctaacatgcattttgacccctggaatctgccttctcacccagtgggggccctggaagctggacaacacacattcacccctgtgtgcctgtccctgagagtgggggtcaggggagcatgcctggggtggcgaggtgattctgcactgggccgacactcccggctttaactggaaggcgaggaccttccaacagcacaggctgacaggtcttgttccatgggggctgggcacccaaggtatctactgatggtctgaggaatctaccgggatggattcctgatttttttttttttttttctgagacggagtttcgctctagttgcccaggctggagtgcaatggcgtgatctcagctcaccacaacctccacctctcgggttcaagtgattctcctgcctcagcctcctgagtagctgggattacaggcatgagccaccatgctcagcagattcgtgatttttaaaatgaaagggtgactcatgggagaagcctctggaactgcctttgaaaaacaaccagccaagacatgagaaattagttcctctgccatttgggggtttcctgccaactgctgggttttccttttgcacagcagggaggaaggacgcctgtttcccttggtcccggtgaggccaggcctcagcttcctgcccacccgccactgctgctggggcagggaggcagtttccggctgtggggacccagacaatgcctggccaagggccaccatcgtcctcttcctggacacagctcccgcctcatcccagggtctggcctgggacacgccctagaggccctcagccctgagtcactgcaccatgcagatccaccctgattctggtccctgcagagcaggctcctacacaaggcaagaagatgctccagggacaagccaaggtgtatgcaaggcccaggtgcctgagaaacacgtctcaccgaccttggggcaggggctgttacaagaggcttatagtctagtggcagagacaaaaaccacactcaaatcattagtgtacggtatgcactgctcagggactcaaatatgtgacaggaggctccaaacaagagcggagacaaggcgtaaatagccccctgtggactggatgttctgactcctggatggcctccagaaggatgccttttacggtctgtgaaagagctcagggaccaagatgctcaaagcccttcatgcccaagagcccctcctcaggctgggacacgggaagcagagctcggaggtggaactcgtgactgtgtatgggcacatgtgagtgcgtgtgtgtggacagccaggcttagtgtagacaacgtgtgaggctcagaccccaagtgctgactacacctatgcacatccacacctgcgtgtgaaagaagatgctagaaaagaacaaaaataacttaaaaaataaatccaataagatggctggaacatataacaa

SEQ ID NO: 6648 - DNA, 812 bp, Homo sapiens
atgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattga

SEQ ID NO: 6649 - DNA, 3228 bp, Homo sapiens
aatagaactgggagctgagcctggagcggttctgggcttttggttctctgcatcaacacagccagcatgcctatgatttctgtgctgggcaaaatgtttctgtggcagcgtgaagggcctggaggacgatggacttgtcagacaagtcgcagagtgtcctcggaccccgcttgggctgtggagtggatcgaacttcctcggggtctctctctatcctctttgggatctgctcgaaccctccgaggctggagcaggtcctcccgcccttcctcggtggacagtcaggacttgccagaggtgctgggcccctggtggtggggggaaggaggacgtcatccatataaaggggatctgcagcccccacccacgcctggccagccagcttctggctcccttttccggcgggcggaggcgctatccggcggcgggccgggaggccgcccccgtgccggtctgctctgctcggcgctgtgccagcaggcggagagctcgcgccttccgcgctgacgtcagcgcatcccgggccgtatcccgggagaccctgttgcgtggtgatgggttgccagggagacatacaccttttctctgggcctgggccgcagctgcgcggagcgccgggcacggatggcggcggctgaggggagcgaagcgagggagggagagcaagctaagaaacacccagcaggtgctcccccgcctaggcctggctggaggctactggcgccaccctgggggccctgtcagccaggtacccaaggggagggatcgagggtgggcctcaggtcaaggggcagtgttggctgcccttgtgagggacgggaacgtgatagaagagagctgggcaatgccggggagggatgtgtgcctccaacttcattaagtgagggaaacatttgctggggcttgtcagggagccctgagccaggtacagggtggagttaggaacttacgtgcatcagacttaggccttgccatcctgagctccctcgggagacagacaagggcaatgatgggggcggggtgtgtcagagaaaagaagaggctgtcggctgaaagcattatttgcaggtgacacttgagatgggccttaagtgatggcaagcattttttcacgtaaggatggcattcttggcccagaggaaagctgagttccttttcctggaggcaggcgggctgcttgctgacagggattggtggagaagggtttttgttttttgttatttatttttatgtatttatttatttgagacggagtttcgctcttgttgcccaggctggaatgcaatggtgcgatctcggctcaccgcagcctctgcctctggggttcaagcgattatcctgcctcagcctccagagtagctgggattacaggcatgcgctgccacgcccggctgattttgtatttttagtagaggcggggtttcaccatgttggccaggctggtctccaactcccgacctcaggtgatccgcctgcttcggcctcccaaaatgctgggattacaggcgtgagccactgcgcccggcctgagaaggggggttttattgggcagaggagatcagcagtggattcaaaggaggcttggaaggaggcaagggtgtcacagagtgggatccttcagggcctgggtatgatgcctgcactaacctcactggacagtagcgtaggctagacaagattttagagatgtgttgtgaccagctgcactccaggaaaactgtttacattatatcttacctcattcatccagcctttgcatttttgtttgcttgtttttgagacagagtctttttctgtcgcccaggctggagtgcagtggcacaatcttggctcactgcaatctccgcctcctgggttcaagcaattctcctgcctcagcctcctgagtagctgggataacaggcacccgccaccatgccctgcccattttttaaattatttttagtggagatggggtttcaccatgttggcctggctggtctcaaactcctgacctcagatgatctacccaccttggccccttggcctcccaaagtgctggaattacaggcgtgagccaccacgcctggcccagcctatgcattttttttttttttttttttttttgagatggagtcttgcaccgtagcctaagctggagtgcagtggtgcgatctcggctcaccgcaacctccgcctcccgggtcctggttcaagcaattttcttgcctcagcctcctgagtagctgggattacaggaacgtgccaccatgcccagctaatttttgtatttttagtagagacggggtttcaccatgttggccaggctggtcttgaactcgtgacctcatgatccgctcacctcggcctcccaaagtgctgggattacaggcatgagccactgacgcctggccagcctatgcatttttaagaaattattctgtattaggtgctgtgctaaacattgggcactacagtgaccaaaacagactgaattccccaagagccaaagaccagtgagggagaccaacaagaaacaggaaatgcaaaagagaccattattactcactatgactaagggccacaaatggggtacgttgatggagagtgatttgttaagagactacagagggaggacagactaccaagaggggggccaggaaagctcctctgacgaggtggtatttcagcccaaactggaagaatgagaaagagctagccagccatcagaatagtccagaagagatggggagcactacactcactacactttggcctgagaaaatagcatgggattggaggaggctgggggaacaccacttctgccgacctgggcaggaggcattgagggcttgagaaagggcaatggcagtagcagtagaaaggacagggtaggagcagggactttgcaggtggaatcattaggtcttatcaacagatatgggcaagcaaagccaggggagaattgatggtaatgctgaggtttggagccaggctagatgggacagtggtgggtgatgcaaaggaaagaggtcaggaagcagggccagacgtggggagaaggtgtgggggtttggtttccatcttgccgagtctgccggaatgtggatgggaagaccaagaggaggagcaaggggcagaggggaagggaatcttaaagaagtcctggatgccacactcttcttccttcctcctcttccctctcctcagaggtctcactcgtggttcttcatttcctgccctgcctcc

SEQ ID NO: 6650 - DNA, 1759 bp, Homo sapiens
ctggactggaccttggcgttgggccgcagttgcccggagtttttggggcccccgggaacccgcgcgccgaggccggctaagtttggcagactctctgagctctcggaattcgactgcctccattgttgctccttctggcacccacagaccgtaacgtggccgtaattgtttcccggagagcttagcttccctctgagcacctccctcccctttttaaagtaccttcccactcgcctgcgtttcctcgcgttagtggtgcaggggcctccgcatttggggaaataacaaacacccacttccgccccccaccccaaccgggatccccagataatgagaaatagatggtggccctctgtttgtaagctgttcatttgcataggtcggaaccgcgcaccacagcttgaagctaggaattaaaatatcggtgggaattaaataagtggctggcttaaagaacatcttcttaatttatccccaaatgtagacatctcttcagtggaccccctgataggccggtttgctccaggtgaggtgtgctcacagcaactgcaaccgtgtttctttcagaccatgggcgtgagcagaacctactatgcgcccctgctgcctgggctgtgctgttcagtttggggccaccagccccacatggctcctgagcacttaaagtatggctagtcggaatcgagatatatgcattctttaccaaataatgttcaaaaaattgttacatgttgaagtgataaactttttccatatattgggataaaagttttatttgtttattttttagtgtgggttctacagaattttaaatgtcacctgtggcctgcattatattgccattgggcaggctgatctagggcttgcatgcctgtgatccttaggtgcaccctgtgaggtaggtgctttaactgtgtgcaccctgtgaggtaggtgctttaactgtgtgcacattgtgaggtaggtgctgaaactgcttcctgttttttttttttttttcttttgagacggagtctcactctgtctccaggctggagtgcagtggtgcgacctgggcttactgcaatctccgcctcccaggttcaagtgattctcctgcctcagcctcccgagtagctgggattacaggggcacgccaccacacccagctaatttttgtatttttagaagagacggggtttcaccatgttggccatgatggtctcgatttctgaccttgtcatccgtccgccttggcctcccaaagtgctgggattacgggcgtgagccaccgtacccagcctgcttcctgttttaacagacgaagaaatggaataacttccaacaacacaggttggagctgaaggagtgcccaggctgcggatggaggaaggacgtgctcgggagaaggtgaagatgggagagaagcaagatcttctgtgtttggaccaaggacacatttccttactccatagcagctgtggtcagtggcttagctcggacaaggagatgagagcccatgtgttgtgagggttcttctgggaactctgagaaggcaggagccgcccccgcccttcactgcctctcttccattctgcagcatggaatatggatgtgtggtctggatgtacagacaccattttggaccataaagacaaggacgattgtctaaggatgacacagccagagcactgagagtggcgagaaggacaggggagctgctgtgccaagcaggactgtctctcttaagagaaaaataaaatttattggtgtttaaacc

SEQ ID NO: 6651 - DNA, 470 bp, Homo sapiens
aatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggtatcttttaatactgctttaaattgtctttccctggtcttgaagaagtgggcctttggtatgcaattaaggaatgctttgtaacatgaataaagctcttgaaactg

SEQ ID NO: 6652 - DNA, 676 bp, Homo sapiens
aaagggatttcacctcgtccttgagagcaacacggggagcgcgagcgagcgggcgagcgagagacggggggagagagagggacacgcgcgcgcacacacacacacaccggcacacacgcacacacacagacacacacacacagagtgaaaaaggcgagccaccaaaacccatctccagtctcctcccgggggcccccagcccgcctctgtgccactttgcatcccacgccggaggaggcattaacgagaccgggtaaggctttttaaacggtccaaggtgtagagccatacttcaggaggatcctcagaagttttggacaagcctccccaaatgtggcaggtgctgtgctggccattggtgacccaaagatgatgaaaaatatgttcctgcccacaaggagttagcgacctactgggctttcctcttgctgatgacatgattcctgtttgaatctgttgacaagattctgaaagctgaacagagaattctggcactgcactgggtaggaaaaagcatttcaagaaatagataatatcaaggacatcaggacaccgggagtgggagagattggactgggagactcagcaggtcaggacatttacattaccatttgctggtcattcttttgccatcagttttacaattctcaaatctcttgccacttgcttatttctt

SEQ ID NO: 6653 - DNA, 581 bp, Homo sapiens
aattgaaggcggttgatggtgaagccattctgagtttatgtgttgactccggtttaagtgacacttctccagatgaagggttaatagaggacttgactatagaagacaaagcagtggagcaactggcagaaggattgctttctcattatttgccagatctgcagagatcaaaacaagccctccaggaactcactttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttga

SEQ ID NO: 6654 - DNA, 574 bp, Homo sapiens
aaaagtgtttagtaagctataaagtacttctgtttttccattcattcattcagttcatatactcgaatgcctgctctgtgcttgctgggcactatgcaaggcattcagaatgaggggaacatgccagacatggtccctgcctcatggagcatatggttatttacttggtgtagtccaaataaataagtagtttgattagtccaaactaggcatatttccaaatgagtgagggaagaaccaggctatctgctcactactttctgccttcccagctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagat

SEQ ID NO: 6655 - DNA, 1514 bp, Homo sapiens
gcgggcagctggagcgctacctgggcgcggcggcccacggctgcggcggcgccaccgtgcgccacgctgttttcgcggctaaaggccgcgcggctgactgcgagagcccgcgcgagtttcgagagcgggccctgcgcgcctgatgggtcgaggcggacgcgcggctgcgtcaggttatccaaggacatggaaaagccaacaccatggtagcattaatgaaagtttaccaagaggaagatgaagcctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggagtgtctgatatattgtgcagaatcaacaagatataaagcagaatggtaatcctggttttttggtcaaactatccatatgagcctgtctgtctagctagacatagaaacaatatggaagcaagtgtgccaaaatataagaagcagttgcctcaactaggaatgcaaaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaaggtaaagtttatatttaagtatatagataacaatgtttataaatttaaggaaatacagaccatattatcaattactttttgtaaactgtaacatctgaaaatttcctaaagttttccttcagtagtttattattcaaataatatattcattgttagcacatagcaaaacaaagaaagaaaaatgattattacttcaatcccatcatctagagatgcttagtgtttggctgggcacagtggctcacgcctataatcccagcactttgggaggctgaggcgggcggatcacttgaggtcaggagttccagaccagtctgaccaacatggtgaaaccccatctctactaaaaatacaaaaatactaaaccctgtctctactaaaaatacaaagtccgatgtggtggcacgtgcctgtaatcccagctacttgggaggctgaggcaggagaatggcttgaacccgtgaggtggaagtttcagtgagccaagatcgtgccactgcactccagcctggaagacagagcgagactccgtct

SEQ ID NO: 6656 - DNA, 824 bp, Homo sapiens
ctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatggaatggatttggtctttgaaggaagccaaaggttattctgccatcaatttgataaatatatggaagttcagattgatttatgccctatttttcttcagaaatgaattgtgtgcatatgtgtgtctgtgctgtgtatgctgggggaatatgtgataaagcagaaaaaagaagagatttgaaaattatctataaaggcaaattaggtttttttaagaagacagtattcttttattgagacttaaaatttattttattttttacattgatagataaaattgtatgtatttaccatgtgcaacatgatgttttgaagtatgtatacatactggaatgactaattttagctaattaacatatg

SEQ ID NO: 6657 - DNA, 567 bp, Homo sapiens
ttattcttcttttacagttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaa

SEQ ID NO: 6658 - DNA, 1042 bp, Homo sapiens
aaatgttcagaggtggtggctagctggaggggaaaaaaagaacgcataagaagaaaatcagtgagcatttcactctccatggaaatagtattttattaacatagtgaaaagcacacactgctttggacctgtgaacttagtgttcagtgttcatggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctg

SEQ ID NO: 6659 - DNA, 2890 bp, Homo sapiens
atagtgcgcatgcttgagcccacttacctaacacctgagatcttattgggacgctgctgataaccagtttcagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtccacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccacgaaaacaagcatcagatacactacctctaagtatttattggaggggttccaacagcctcgtggacaggccttctcagcagctactgagtgccccctaggggtggggaggggccagtgcacatggaggcaaaccacagagcccttttgtggcctattattatgaagaactaaaatgtggccagtgaaccagtcagtgctcatcactacggggtactttgacaatggcacaatttcattttaccaaaagaaaccttcactggctctggggactgcaatatcttcattttaaaatattttgctgcgttttcttcaagggcggcttgtgacaactgaactgctgattattccttccatggacagcatggtagtggcaagtgcagtaactgggctcattgcattttctctttccatacaagttactgcaactgccatgtgatcacttttccagcaggctgacttcgatttgatttttttcttatttaaatgttagaaacatctcagggctattattatttatctacaaagcagaaatcagccaaagacaaaggaaaaaagtaagctaatcagaacctgaagacctgaaataccacatgaaatgtaaacatttaactttttatttccaaaggatttcttgaagcctctctggagataatgacatcaccacacatactgttaaacaatcttttaatacctttggaattactctttataatttttatacttcaaattaagaaaaccgcccaatgttcaggcaactttggcattaacatttccaagaaagggacaaaaacaactattaatgcaacatcatgaagagattggggacaattgtgggtgtctataaagctctctttgaaaagctctttaaagcgaactcaggtaaatggaaatgaaatctgactttttacttaggccaaataacaatgaggtttgaatataaaatggaagattcaggccctttctacctaagatgaaggcatttagtttgctcaaattcaaactccaccaaatactctgaatggaaagtttggcaacagaactggacatgtggaggttcaccaaccattttgatcaaaggtgatctgattttatctcacttcttgcctaacctttctggcttctttaccttgactagatgcctgtggcattatataatgatgcagcccagcagaagtaggatgctaataaaccctggggtaaagcagcaatcatctgcatttttaccacatacacttgaataatccaaaatactgagagttgcttccctatgctcaacatccataggaccaaatttggaaaggtgaactgtagttggcttatatgctggccttaggtgctcttatgacctgtgcttagccatatttagctcactggctaagaggctgaaaagattctaccaccttcaggtgtgtggggaacatgaacaggaggctgacaaacaaggagggaagtttctattgtacctggtgagtgggttttatgaaaagaatatgggtagggatgagtcagtgatattttggttttatcactttttggagaaacatacatatatatacataaatagaacacatgtttttatatcatttattgacctgaggccaaattctactcgattttctactttccccctactaagagatccagaaaagctattaacattagagaataaagtattacttcttctggaatcctttctacatacccctttgtactctgggaaggtttgaatgtgaccaggaaggaggagatatcaacacaggctaagttaattaacgaaaaacagcattctgactaacctatagttgaatttacaaaatacacttcaaagctatggcctggtacagggggaggatgagatactgcacatatttttctctctcagccttatcaggctaccatgggaaagctatagacagagatatattattcttcaccataaaaagcctgcaaaccccattttaattagccccaaagaactgtgccctaaaatgtaaaatgaaataaaaatctctggataaca

SEQ ID NO: 6660 - DNA, 739 bp, Homo sapiens
cttattgcttaccgtgctcccttgctgcctttttgtgtgctcagcttttgactgcaaagtagacttgttgccttgccaattcgttcactctttaaacccttttatcttgttattaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtggggcgggctggcctggagcctggagaggacctgtgccacagctacacccccactccccacagatggctcggttttcttgattatttacaaagaaaacacatcctctgattgttagtagagaccctaatttatggcagactggctaggtgcagtggtggctcatgcctataatcccagcactttgggaggccgaggcaggaggattgcttggggcctggagttcaagaccagcatgggcaacaaaacaagagctcgtctctacaaaaaaaaaaaaaa

SEQ ID NO: 6661 - DNA, 2001 bp, Homo sapiens
gatttacgcgcacgttggaaccgaagagagctctgttgttgcaatgttcagcccacaagagcttactggtgaaggaatgggacaagacccatctttatgcaaagccagcgttacagtaatgttccaggtattcctgatgacagtctgcctctatcttacagagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaaggtgagtaatttcacggtattcaatgcactcagtatatagggtaggaaaaagtgcctttttaggcctgtgtttgtgatgacttacatggaatctcgttcggctgatgacttgctgttgagactctgaaatctgattttctgagaatgatgggtgggaacaacataatgcgggatatgagaagcactactgacttggtcttcctcctttcagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacat

SEQ ID NO: 6662 - DNA, 2296 bp, Homo sapiens
tttggtcgtctctgccccagtcccttcgccgcgggacgcgcgagacgggagaaggtgcgggaagcgggaagcaggagcgggagcgcgcggccctggcacgcatagggcggcggagagggcacgagcagggattgagcacctactgtgtgccttcacgctttacaaaaggattttcgttcgatgttcactacagcccctgcccgggggtactgatgccccatttacagagggacaagccggatttcggagaggtgaagtcactcgccgaaagtcgcaccgccagggtctgcgtgacaccctaaagcagtgttcagttaccccggggagagcgcgatgaacttgaaccacttgttggctggttcctgctcttgctcgttttttgcggatcgacacatagtgggcgctcaggaaaataaatgttggaagcttgagattgaacttgacagctcgaccctaggtacccgccacgaatccagcccagcccgcggggcaccgggtttctccagacctcgcagggaacatttgcggatgggctggtagaggaggctcggacatcccagttccgcacccgcactcgaccaacgcgtggtagcggaacccctgtcgtagcgaggcacagactgggttcaagtcccgactctgccgatttcagcctgagtgactttgagcgagtcactttttcccgtcgaaacctcagttgctccatccacaaaatgggaaatatgaacagccaccctaaaacggtgtggggaggattaaacgaaacaacgttcccaaaactctaaacttacaaatgttgtctcccgtccatcccataaacttaggcgacaaacctggcgcagggtgacctgagacaaaggcttcccggcccctgtctccaagtcgtccatccctggggcgtaggcacgttttagtgagccctgtccggcgaaacccgaaactgcggccaccttggcagcggtgggccccaaaaggaaatattcaaatattctgaaactcgtgcatgatttaggactgacatttttacgtttaattttcttgcagttttattcttgctagtaaaggtaattcgttagaaacccttaagtgcagtttctcctctgtgtcttgtttaacttttcgtgttagcgaaattcacaaatttgaccaaggaaccggagcgcggccgtcctcgccgggattccggtcatcgcaataatctggctctcggcccctactcccaggcacggaggtcgaagagacgggcttcccctacaccgccctgtgtagatgtagcctcttcgtcccggcagccctccgagattccctgtgtccaccggagcgaggagaggtgtggggctgcagcccagaactcagcttcctggacctccccaaactcccgcctctccgggattaagggagtaaatccctgacgccaaagaccaggtcaaggacaagttctcccccgccctactcccccctcctgggcggggattcatctcccttccggatgaaaggtactaaagagccgacggggggccgcggcgggccccaggcccttgatgttccggttgaacaggtgctggtgaaaaggaggcggacccggcggaagagtctgccagggggcagtgcgccgaaggggaggcggcctcctccacccccagtcccccggcccgtcttcccttctcctctctgtttgcccctcccccgcaggaagcgttcccggccgcgaggtctttgaagtgtcgttgaagcccccagggctgccttctcccctacgccacccgaactcccgctgtggggggcgggtgacctttagtccccacgagtcgtccccctttaggaagtttttgggggtcagatctcacccccccttgcccacacaggttgggaagaagactttgggccgacgcccctcacttctcccccagacccaattgcagggactttagtcctctggagtgctgcgtgtgagttaccttgtgtgtctgtgtgcgtgcctagaggtcaagtgtaactggtgttcgtgagcacctcgtggttgcgggtctctaactctcgtgggtctctaagcgcacccgcggggctggagcggaggttcgtgtctctgggagggtcagtggtgtgactgaagctgggagttagctcgtgtctgtgggtgcctcggtgtgtgtctctggggctctgagtccctgtgcgtgcgtgtgtgtctgtgaacccgacaggaagctccccgagggcaggaatatgttttgctctctactcgatcccagcgactggcaacgagcgtttaataaatatctgttgaatgaataaa

SEQ ID NO: 6663 - DNA, 5603 bp, Homo sapiens
ggttattaaaagtagaagcaaaaagtcacccatagtccttttgcctgaaataactcccattaacattttgatatatttcttcacagatgagaaaaaattaagaactttccccccttccctgccctataatccaaattgtgtgggcaaatctgagattactagatgtattggaaatcctttctctttcatagataaaaaaacagaagtagacagaattttaaaaatagatatactatgggatggctattggagtcatggcagttttttttttcttaaatgaaaagtacttttatagaaattgttctttgaaaatattcagcaaataatcatttattgctttctatgtgcagatcaagtttgtatgataattaaattattgataacttatacctacgattttaagaatattttcaaccctttggtcagattgtctccaattagcataatagcaaagagacttttcaaggttaatatgaaactttttctcagctatttttttattgtctatttctcaggggaaaaaggaaacttatcctcttaggcagttttcataatgttatacatttaaaaattaatctgaaggagcttaaaatataaatgcattaggtgaaaaatagcagttgatttaaataaaatgaaggaggagaagaaaaagaaccttaccgacacaaaatagaatgagattggtttgcagatggcgagcgatgttgcttctgctcgcagtccccatttctgtgtatgccggggcgggttggggtgtgtatttgaaaggaaagttggctttcttttttcagaagggaagaagagctgaagagaggaacctcttatgaaggaaccataatcaggaactttttgaaattgtgcaaggatggcttcaccatttaacattgagattttggcctggagcacatttagaaatgtgcatatcttttttttttccatggattttacagttgtcataggtgttagatgtttctgggtgagattttgatttacacctagcacatatttccaggaaggagtattgtttgacaaataattcgtacttggatttttcagaacagttcagtcactgtctagggtacctgctctgggtgccactctgggccagtaactgctgggaacaaagaacagcagaaggagaagtggctttgtgtagagatgagaaaagttagtaaacaacacattctaatgcagcgaataaataaattgtctgttattaactttttgtactccagttttgaatccaaagacacctgccttccccccttttttgacagggtctctatcacccaggctggaatgcagtggcaagattgcaggtcattgcagcctcagcttcctgagtagctgggactacaggcatgcaccaccacccctggctaatttttttttttttttgtagattctgtgttgtctaggctagtcctgccctcaagcgatccccctgccttggcctcccaaagtgttaggattacaggtgtgagccaccatgcctggcccaaagacccccttttaatgtgttgagaaacaaatatgtgggccctctgtcctctgtgtcctctcccccagcacttagtggtgattcagtaagggtcttctttgtaaagcagcagaaacagactcaggctgacttaaaaggaaatttatgcaaacatttgaaggtagatcctagagtcactgggagggctagtgaatcttgtgtggggtccacagccaggaagaatgcctcaaatcacaccataaacaggtctgaagaggatgctactgccactgccaaacactaggtgccatcagccctgttgtcagcatcgctcaaccactgccccagccccttggtctcactgccattgctccacccccagagaaggagaagctcacatccccactactctgggtcactggctctccattccagggcatgggcaagtgtgcctggcttaggctgcgtgccagtgcctcagctgcacggcaggccaggaaagcggctcccaggccttgtgtctctcccagactctgggcaggcaattccccagacatgggaagagcgtcatctgcaccactgaaaattatgaaaaatctccccaccatgatatgatgtctgtgcccttggcatctgctcatgatatattttctcattaacagaaagttattctcagtctgttttgtttttttttttttttttttttttgagacagagtctcgctctgtcgcccaggctggagtgcagtggcacgatcttggctcgctgcaagctccgcctcccgggttcacaccattctcctgcctcagcctcccaagtagctgggactacaggtgcatgttgccatgcccagctaatttttttgtattttttttagtagagacggggtttcactgtgttagtcaggatggtcttgatctcctgacctcgtgatccgcccacctcggcctcccaaagtgctgggattacaggcatgtgccaccacgcccggcctcaatctggttttaacacttcaacagatgtatgtagtttttgtatcaccatagcacctaaaaagtacccccaaagttaaatatactgtcatctctgtgtgtgtgtctgtagtcagtgccaggtttgtatgtgaatttgaggaccttccctagtccccttgtcccccaggcatctcctgctcataggtttggaaatgactgatagaggcttcatctctagtccaagaaatgctggacggtgtatccatcctactgttccatctctctctggtcctggagcttaatgtttatgaaattgttctgaaaaggcaaagaatgagtcaacttccctagaaaaactccccaatgatctgcttttctaaattaaaatccttcatgagcctgtttttattttcagcctaataaatctctctaggtagtaagttgcataagtttactatgccagtggtattttcttgcatttgtccaaaactgtccttcagatattacatgttgctctctgtttcagtattccagcatttaatgaccagttttccaaacccattaaccattacaccctgcagtcagtctattggcagatactacccaaaactgtcagagaagataacagtgtggggccttggatccagacaaacctgggcttacatttccatactgacactcattaaccttgcaagcgtgggcaagttcttcaccccttctgagtctgttctttatctgcccacctgtctcaaagagtacctgggaagtacaaaagaggtaactcatgaagccctcaggcttggaacgtaccaagtccttggtagatatggctcctccctgcttccctctttaaatcacttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcacca

SEQ ID NO: 6664 - DNA, 1163 bp, Homo sapiens
cggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactggtcttgttttgccacccaggctggagtgcagtaatataatcttggctcaccgcagcctcaacctcctgggctcaagcaatcctcccatctcagcctccctagtggctggaactacagaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaagtttcatggatttgaatgtgaacatctgttccctggacgcactgccaacaacgtggtccaactggtactcatcgttggaactaccaagtcaactaattttttttttttttttgagacagagtcccactctgtcgcccaggctggactgcagtggcgcgatcacagctcactgcagccttgacttccccagggtcaggcgattctgtcacctcaggctccctagtaggtgaagactacaggcagacaccaccacatctgagtaattactttttgtagagatggggtttcgccatattgcccaggctggtcttgaactcctgacctgaggtgatccaccagcctcagcctcccaaag

SEQ ID NO: 6665 - DNA, 1110 bp, Homo sapiens
cggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactggtcttgttttgccacccaggctggagtgcagtaatataatcttggctcaccgcagcctcaacctcctgggctcaagcaatcctcccatctcagcctccctagtggctggaactacagaaagggtacattcgccagcagttttgccacgagagtacaccgaacaaagagacagggtcatttgtaacctgatgcgtccaccctactgctgtgtccggtttccattggctggaacgggacctcatattctgtatttgtcctgattgggaagcaacttaaaactttttaaaagaggcgaaggcagaagagaacaaaggaaggagaaagtaacttgtggaatggtgagaaaggcatgaggcgaattctcagccatgacaaggctgaaggccagcaggaacaggctctagcgaaatgggtgctgtgtccccttcctgcatgtggcagaaagttgcaaagtttcatggatttgaatgtgaacatctgttccctggacgcactgccaacaacgtggtccaactggtactcatcgttggaactaccaagtcaactaattttttttttttttttgagacagagtcccactctgtcgcccaggctggactgcagtggcgcgatcacagctcactgcagccttgacttccccagggtcaggcgattctgtcacctcaggctccctagtaggtgaagactacaggcagacaccaccacatctgagtaattactttttgtagagatggggtttcgccatattgcccag

SEQ ID NO: 6666 - DNA, 2828 bp, Homo sapiens
gtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcaggtacccagacttcaccctcaggtcaccctcacctggactttggggtgccccacaccccgccccaggccctggcctctggaatatttggaaacttgaactgggccagaggcttaagctcacatctgtctggagcctcaactttctcctctgtaaaatgggctaacactgaaagaaccttgcagaatctcagcaacgtcacagaggacattgttagcacagccagcgggctcctgctgggctgagtttgtgggtaatccaagcctcggcaggtacagttcctccctcagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccaggttttttcagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgctgggattacaggcatgagccaccgtgcccggtcaatttttatattttttgtagagacagggtttcaccatgttggccaggctggtgtcgaactcccgacctcaggtgattgtcggccttggcctcccaaagtgctgggattacaggcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaatgccgttccattgtttgctgactttcattgattctatgagaagtctgcagtcttttgcagcgttgttttcctatgtataattgtctcctccca

SEQ ID NO: 6667 - DNA, 702 bp, Homo sapiens
atcccttctctcttccttggtgcttctttttcctgctcggtgagtttgtttgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgagccaccgcgcccggcctgagtgagtcttaatccgtggccatctgcgttcctgcaggcttcatctggccctatggtcccctggcatcatggctgccctcagatcccttgtgaagcccaagatcgtcaaaaagagaaccaagaaattcatccggcaccagtcagaccgatatgtcaaaatcaagatgagaagaataatgtctggggtgaaggtgaagcacccagcccaagactcagcagccaggaagtggcccagcgctctttataccacgggtgcaggaattcacacagaaaagtggaggccaaggcgtgagaattcctcaatgactgccctctaaaggaagaggtgagtgtggggcctgctctgagtgcta

SEQ ID NO: 6668 - DNA, 2951 bp, Homo sapiens
gctgaaaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggggagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggctcctgggaccacattatcattctcttcactcgagagatgaggacactgaaattcagagaggggaagtgatttgcctcagcttgtactaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatcaaaggagatttctcccattatatacttcttatgatcaacaaattccatcatctccccactaagagaaagtactccaagatgatagaatgattttaaagttatgggactacaacagcagccacaggaaccttgaactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatgcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttc

SEQ ID NO: 6669 - DNA, 1745 bp, Homo sapiens
ggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaa

SEQ ID NO: 6670 - DNA, 2184 bp, Homo sapiens
aacaaattggtaatcggtggttaaataaatatgcccaaagtcccacagctagaaagtagcagggctggaatttgaacccagtccaataaaacctcaaaaccggtgcactttctaccgtatcctgaggcttctttactttggggccctggttagccttagcagcctagttttctacatccttcatgccagttgaatgaaactactgacatgctccacattcttctttctcccatgcttttgttcattcagttacctcctcctaaaatgtctgcatttacccagataatcttccaatggaaatccatggttcaagtgccacctcttcaggaaagccatctgacttcaatcaggaagccagagagctccgtctgcagcagctctttcagctccttcttgctcagcttgtacttgtccccctctttgcccgagtgggcgtggaacacgttgatgagggtctccatcgccgtctccagctcagagcccattgcagcagtgcacctacccacccccatcatggaagtgagctgaggaccaggcccggagtacctggggtctaggcagcagtggatggtgcaggggaaagaggtgggaaggaggtcctgggagggacactggatgtcttaccccaagctgggccttgcagtacctgtggctggctgtgctggttgagcccgaatcgaccacggaaatttgacacctccgggcttggaagcagctctctcctccttccccgctgcttataaacctcagccctgaggctccagctcactctaccccatctccttgccgggtgagtctcatggctgaccctggagggaggctggagatcattttttcttcctgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtgagtctgggtgagacaagaagggattcttgagacagacacgccacagaggggccaccagacttgaaggactccaagaaggaccttcaactgaagacctcctctcaagtagaggggtctccagatcgagggatcaccacagaggggtccctaagccacagacatttaaaaaggatcccggattgtgagacctacagaagagggggtttctggagctgaatctcctgcccccaccaaaactgagatgccgttgcctggtctgctgccccaagctcaacccctgtcctctccctctttccccatatgccccctccaggctgagactgatgtgataacaccaaggcagggaccttctgaaccattcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggatgtgggctctcttgatgagaagatgaagagcttggatgtgaatcaggactcggagctcaagttcaatgagtactggagattgattggggagctggccaaggaaatcaggaagaagaaagacctgaagatcaggaagaagtaaagccgcctggctgagatggggtgggcagggcagagctgatcagggccgagcagaaccgcactcttcccaaataaagcttcctccttg

SEQ ID NO: 6671 - DNA, 477 bp, Homo sapiens
agtaatggtccagctgcttcacaggcaactggtaaccacctcatttggggatgtttctgccttgctagcagtgccagagagaacttcatcattgtcacctcatcaaagactactttttcagacatctcctgtagggctagattcagagagcagcttctgatatttggagggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggtaaataccttcaagccaaatcttgaaaagctgaaagccctgttgtctacacaaggccacactgtgtggggg

SEQ ID NO: 6672 - DNA, 4169 bp, Homo sapiens
gagaagcaaagtcaagtcatgacattacaagaacaagttgaattgcttgatatgtaccatggattgaggtctgcagctgcagttgcccaccatttcagacagacgattcatcttaaaaagacaattgaaacttacagtatcagtaagcacagtacggtactgtaaatgtattttcattacgattttcttaatattttcttttctctggcttactttattgtaagaatacagtatataatacatataacatacaaaataactatattatcagtaaggcttctggtcaacagtagcctattagtaaagtttttggggagtcaaaatgtatatgtgggttagtcagaatgcttaactgacattgttcaaaagtcacattgtatttgcttttctctctgaatacacatacacacacacatatatttacatttacatatatataaacatatatataacacatatatatgaaccatttgggaatttgttgcagacatcaagacacttctcctgtaaatacttttgtctgtatgtcctaagaacagtcattctccttcataactacataaaattattgcacccaggaaactgatatattatctaatattgagttcatattcaaatttatccaacttttgcaataatgtctcttataattgtgttttcctcctaaaccaagactcaaaccaagatccagtccagaatcacaccatgcatgtaagttgtagtttcttgacccttctttgatctgcagactgctgccctatcactttgttctttcacaatattgccaacttttggctgggtgcggtggctcacgcctgtaatcccagcactttgggaggctgaggcgggatcacttgaggtcaggagtttgagaccaccctggccaacatagtgaaaccctggctctactaaaaatccaaaaattagctgggtatggtgtcacgtgcctgtaatcccagatacttcggaggctgaggcaggagaattgcttgaaccggggaggcggaggttgcagtgagccgagatcgcaccactgcacttcagcctgggagacagagtgagactctatctcaaaaaaaaaaaaaaaaaagatattgccatcttttaagaactcaagtcaattgctttgcagaatgttcctcaattttgatttgtctgattgtttcttcattaatcaggttgagcctattagaaatactacccagatgatgtgtgttcttcctgttcctcacaccaggaggcacacagtctcagtttgtcctattactggaaatgctaagtttgacttttggctaaggcaatgtccagcaaatgtctccattgcctgaaaaatttcccctttataattaataagtaatccaggaggtgttactttaagactgtgtgaataacctattcccagtctttcacctaatagtttcagcttccactggtgattcttggctgaatcaattattaccacgattgctgcaaaatggtggatttccaattttataattcctatatttattggttgtcattctactgttttgaaaaagcatctttacttctctctccttttatattaatattagtgtagtagttgtggtaatatgaacccatggattctttttaattgaatgttttaaatacttgtcaaattatacaaaattcaaccaacggcagccccttcaaacttattcctgtggccttttgacattccttgggtgcttctgttttctgttacaggcctgaggtgtcagcaggaaagacgtactagtggcccctgaagccctgttacctcgggcctctaggactttcgataggccgcctcccttctcttaagagcccacaggttggacctccaggttcttccctgggtgctcccggaaggacgctgcttcgggctcctcccgggggaactccattctaggcgcccggctcccggctcccccgcccgcccaaccccggagcgctccattctccttgccaggctgcaaactccgcctccggtcgctctggccgacggcctccacggcggcagggggcgacctctcggcaagactttccgccggggtcccagcccggcaggagcttccggagagatggcgggcgacgtccgtacctctccgtctttccctcctgggctggtgccgtggctacgccccggccgctccacacacctacccggggggaacgtgtgcctgggccgctggagtcgcgaatggccggttattcacacgttcaagtacccaaggcaggcggccctgcaggcgtcgtcgcgggttcttccggccatcttgttgaggagggaccggaaggaggagcggctgaggagcccaaggagcggggcggcggccactaggagctcaggaggcaagggcgtggccgagtgggacccacttgcctgcctggacccagaactctgggatcagtttgacaacttagaaaatcgatagtcttgagaaattcatcatatctgccaaggaaaggactgagattgaactcagctatacaaaacaactcaggaatcttttaaagacatgccaacctaaaaggaactggaaggagaaagaatacattacgtaaaactctccttccctccctgtgaacaaaatgagtgatcacgctaggcagcattaagttatcttctttgaggtcttgaactttcagatcaccgtggagttacaagggcatgttcaaaaccaaaagcaggagaggaaatctcactttcatgatgcccagaaggcacaaccaccgacagagacttgatggaagcaacttgaggcaagtaaaagacaattgagattataaaaaggctgctgagcacatcagtattttgagaaaatgccatatgttttaaaaacacgtttttaaaagtcgatgttgaaaaaggcacaccaccaagctgcgaaaacatcaccaatggcagaagacggcagactactcaatgagaattgaattactcatcaattcaagaaatttgacactgagctgcaggaattttaccatcctaatagttccaacaacttccagaaaatacaagagatagagggaaagaggatagtgagaatgagagaatcagtgaagacatatgtagcgattgggcaacaggtgatagcaatcaataggagatgcttggagagaatagtaaaggcaactgaatcaatgatcagaaaaatgtcacagctggtaataaaaactttcaagtcagagtgtgagcctcctggagacatctgaggactacactctgccaataaggtgcttgataatagtctttcagatttctgaggagaaggcaaaccagggtcagctgtggtggcaaattgaaaggaaacttctggctgttcataaaaatgtataaataaagctccaaagcagcaaaaggaactgattggtttaatgagctcgttatcaaacccaatattggctgcttcaaaagtctataatgtaggctgggcacagtggttcacaccagtaatcatcccagcatattgggagtctgaggcaggtggatcagtcgaggtcaggagtttcagaccagcctggacaacatggtgaaaccccatctctaccaaaaatacaaaaattaaccagatgtggtggtgcacacctgtaatcccagctacttgggaggctgagatgggagaatcgcttggacctgggaggtggaggttgcagtaagctgagatcatgccactgcactccaacctgggtgacagagtgagactccatctcaaagaaaaaagtctgtagtgtaaggggtgtaaccccagaggatgttggcagtcttccacctcaactgaaaaggaaaaaactacaagagaaagtcaatgaaataaatacagatggagatggatcaaagaaatggcataacaaaaatgaaaaacatgtacaaaagaaatcttcaaatgggagatacagccagtttgagtcacaaattaacaaaattcagacaaaaatatagaaaaacaagaggcccagaaatttgaagtctagctgcctgaggttgaaggcaggctcacacaatcaagtgaacaggcctgacaacagagtggaatgtacaaaaacccaatccaaaatcccagagaggtttgcacaagactggaaggactcagaaggcagttacatagaggagccagtcaagaaagtggggtgaggagttctggttgtggattttgatagtgaaa

SEQ ID NO: 6673 - DNA, 1015 bp, Homo sapiens
agtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggcggtcacatctggaaatggaaagccgacctccccctcctcctccacctcctcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccgaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaaccctttttatgtatctttaaaattacattggttctattattttatgattacaaacgatgctgcagtcat

SEQ ID NO: 6674 - DNA, 1185 bp, Homo sapiens
tgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtggggtgagaagggaaaggaggggtgagggtgcaggggccctcctaggaggacatcggacctgttgggccgagacctcattagagatctagagcacggatgggaggagcagaggctcgatttgtgtcctgttcagactcccacaggctgggtgatggtgggagatttgtgcccattcagatgtggcggcagaggagggcaaggccgaaggagcagacagcaccgcttcttggggagttgtgaaggcatcatgcggagggccgagcttagcagccaagtggaggacagcaccctccatgcctggattcgttactcgctcgttctcgatgttgagctgctggcatattgcagcacaactagagatgtacggatgcccccatcttgatcttacagaatcagaggtgcagccgcaagaaagctacaccctctcggttttctctgctctgccaacactagtggaatatgatcacatcccagggatcagtgtcatttagggatgtgactatgggcttcactcaagaggagtggcatcatctggaccctgctcagaggaccctgtagaggaatgtgatgctggagaactacagccaccttgtctcagtagggtattgcattcctaaaccagaagtgatcctcaaattggagacaggcaaggagccatggatattagaggaaaaatttcgaagccagagtcatctggaattaattaataccagtagaaactattcaagaatgaagttcaatgagtttaacaaaggtggaaaatgtttctgtgatgaaagcatgaaataattcattttgaagaggaaccttctgaatataataacaatgggaacagcttctggctgaatgaagacctcatttggcatcagaagattaaaaattggg

SEQ ID NO: 6675 - DNA, 1129 bp, Homo sapiens
gggaaactaagtcacgtgagaacctggggacgctaggttccggaacctgacctgagctggggcctgtgcttccagcgggtggtggggggcctggtgtgctggcatcaagtaagccgactacctcggcaaaggcttagggacaagagaccagcagcctgaactggctggggcatccggaaggcttagatcttgtggccaagagttcagaccgtggcgaagtggagagtgacatgcagttggatggcggtgactgcgtggtatggaagaaaattcagctgaaatttgctagaaaatgagttgttttggaaagagactgtagagaaaggcaaatggaagaagaaagcttctgtgcccccacagataccgactgaaaagtgttagcatgagcaaaagttcctatctaatattatatgctttcctttgctcccagcattccacaatcacgggctacttcaattctgcctgctgagctgatttaataatctggaagaggattattctcccccatctggaagaggattattctctataatcccagttagagacacaatgacataaacatcgctgtcctgcaaccctggttccagtctggcaagcattgtagacctggctgctgaagactgacggggcccagggtccgctgcccccaccgccatcaccacctcggaacccagggtaacgctgtcagtctttgagcctacgaggaaaccattcggaagctccagaacccaggccctaatcacaacgcccctatccagcaggaagcagccagatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctgtaagcgggaagggggctctggcactagctggtaccccctctccgcaggtctttctcccaataaatctgtgttgcca

SEQ ID NO: 6676 - DNA, 578 bp, Homo sapiens
ctagctggcactgaacactcacaggcgacagatggaaaagtttccgaccaacgggaaggttacgatctggtaccagtccagcactgacaaatggagatatgagctcactcactcacagctgtgctcaccttcatgggaagagtcggccctctactccagtacgatgacacacaaaccctggctgcactggggattatgggatcggcttctctgaaactctcttactttttaaaaatcctgtagaaggatcaggtaacaggaaaatggccggtgaattctgtaaaaggaagtgagtagaactgttttgggttagaaaagaagcactttaggcagccaccatgggaagaaggcgggtcaccttctcactgaagataagagaccaagtgctgatggacagcaacaggcagtgtctgaaaactagtccgataccatcatggtctttgagggaaaatctgattccactggggtttccatgtcaatagtggactcaaatttaaaaagtctccagtccatttccagaagtacaagtgttttctacatgagtagaggaatcagaaagaaaccaactcaactctttc

SEQ ID NO: 6677 - DNA, 294 bp, Homo sapiens
ggccaaagtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactggtaagtgttattcttggcatgaacactttttaattgtaattgggggagatctgaggt

SEQ ID NO: 6678 - DNA, 2985 bp, Homo sapiens
atagtgcgcatgcttgagcccacttacctaacacctgagatcttattgggacgctgctgataaccagtttcagagacagggtttcaccatgttgtacaggctagtctccaacccctgggcttaagcaatccttctgcctcggcctcccaaagtgctgggattacagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtccacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccacgaaaacaagcatcagatacactacctctaagtatttattggaggggttccaacagcctcgtggacaggccttctcagcagctactgagtgccccctaggggtggggaggggccagtgcacatggaggcaaaccacagagcccttttgtggcctattattatgaagaactaaaatgtggccagtgaaccagtcagtgctcatcactacggggtactttgacaatggcacaatttcattttaccaaaagaaaccttcactggctctggggactgcaatatcttcattttaaaatattttgctgcgttttcttcaagggcggcttgtgacaactgaactgctgattattccttccatggacagcatggtagtggcaagtgcagtaactgggctcattgcattttctctttccatacaagttactgcaactgccatgtgatcacttttccagcaggctgacttcgatttgatttttttcttatttaaatgttagaaacatctcagggctattattatttatctacaaagcagaaatcagccaaagacaaaggaaaaaagtaagctaatcagaacctgaagacctgaaataccacatgaaatgtaaacatttaactttttatttccaaaggatttcttgaagcctctctggagataatgacatcaccacacatactgttaaacaatcttttaatacctttggaattactctttataatttttatacttcaaattaagaaaaccgcccaatgttcaggcaactttggcattaacatttccaagaaagggacaaaaacaactattaatgcaacatcatgaagagattggggacaattgtgggtgtctataaagctctctttgaaaagctctttaaagcgaactcaggtaaatggaaatgaaatctgactttttacttaggccaaataacaatgaggtttgaatataaaatggaagattcaggccctttctacctaagatgaaggcatttagtttgctcaaattcaaactccaccaaatactctgaatggaaagtttggcaacagaactggacatgtggaggttcaccaaccattttgatcaaaggtgatctgattttatctcacttcttgcctaacctttctggcttctttaccttgactagatgcctgtggcattatataatgatgcagcccagcagaagtaggatgctaataaaccctggggtaaagcagcaatcatctgcatttttaccacatacacttgaataatccaaaatactgagagttgcttccctatgctcaacatccataggaccaaatttggaaaggtgaactgtagttggcttatatgctggccttaggtgctcttatgacctgtgcttagccatatttagctcactggctaagaggctgaaaagattctaccaccttcaggtgtgtggggaacatgaacaggaggctgacaaacaaggagggaagtttctattgtacctggtgagtgggttttatgaaaagaatatgggtagggatgagtcagtgatattttggttttatcactttttggagaaacatacatatatatacataaatagaacacatgtttttatatcatttattgacctgaggccaaattctactcgattttctactttccccctactaagagatccagaaaagctattaacattagagaataaagtattacttcttctggaatcctttctacatacccctttgtactctgggaaggtttgaatgtgaccaggaaggaggagatatcaacacaggctaagttaattaacgaaaaacagcattctgactaacctatagttgaatttacaaaatacacttcaaagctatggcctggtacagggggaggatgagatactgcacatatttttctctctcagccttatcaggctaccatgggaaagctatagacagagatatattattcttcaccataaaaagcctgcaaaccccattttaattagccccaaagaactgtgccctaaaatgtaaaatgaaataaaaatctctggataacata

SEQ ID NO: 6679 - DNA, 2892 bp, Homo sapiens
atagtgcgcatgcttgagcccacttacctaacacctgagatcttattgggacgctgctgataaccagtttcagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtccacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccacgaaaacaagcatcagatacactacctctaagtatttattggaggggttccaacagcctcgtggacaggccttctcagcagctactgagtgccccctaggggtggggaggggccagtgcacatggaggcaaaccacagagcccttttgtggcctattattatgaagaactaaaatgtggccagtgaaccagtcagtgctcatcactacggggtactttgacaatggcacaatttcattttaccaaaagaaaccttcactggctctggggactgcaatatcttcattttaaaatattttgctgcgttttcttcaagggcggcttgtgacaactgaactgctgattattccttccatggacagcatggtagtggcaagtgcagtaactgggctcattgcattttctctttccatacaagttactgcaactgccatgtgatcacttttccagcaggctgacttcgatttgatttttttcttatttaaatgttagaaacatctcagggctattattatttatctacaaagcagaaatcagccaaagacaaaggaaaaaagtaagctaatcagaacctgaagacctgaaataccacatgaaatgtaaacatttaactttttatttccaaaggatttcttgaagcctctctggagataatgacatcaccacacatactgttaaacaatcttttaatacctttggaattactctttataatttttatacttcaaattaagaaaaccgcccaatgttcaggcaactttggcattaacatttccaagaaagggacaaaaacaactattaatgcaacatcatgaagagattggggacaattgtgggtgtctataaagctctctttgaaaagctctttaaagcgaactcaggtaaatggaaatgaaatctgactttttacttaggccaaataacaatgaggtttgaatataaaatggaagattcaggccctttctacctaagatgaaggcatttagtttgctcaaattcaaactccaccaaatactctgaatggaaagtttggcaacagaactggacatgtggaggttcaccaaccattttgatcaaaggtgatctgattttatctcacttcttgcctaacctttctggcttctttaccttgactagatgcctgtggcattatataatgatgcagcccagcagaagtaggatgctaataaaccctggggtaaagcagcaatcatctgcatttttaccacatacacttgaataatccaaaatactgagagttgcttccctatgctcaacatccataggaccaaatttggaaaggtgaactgtagttggcttatatgctggccttaggtgctcttatgacctgtgcttagccatatttagctcactggctaagaggctgaaaagattctaccaccttcaggtgtgtggggaacatgaacaggaggctgacaaacaaggagggaagtttctattgtacctggtgagtgggttttatgaaaagaatatgggtagggatgagtcagtgatattttggttttatcactttttggagaaacatacatatatatacataaatagaacacatgtttttatatcatttattgacctgaggccaaattctactcgattttctactttccccctactaagagatccagaaaagctattaacattagagaataaagtattacttcttctggaatcctttctacatacccctttgtactctgggaaggtttgaatgtgaccaggaaggaggagatatcaacacaggctaagttaattaacgaaaaacagcattctgactaacctatagttgaatttacaaaatacacttcaaagctatggcctggtacagggggaggatgagatactgcacatatttttctctctcagccttatcaggctaccatgggaaagctatagacagagatatattattcttcaccataaaaagcctgcaaaccccattttaattagccccaaagaactgtgccctaaaatgtaaaatgaaataaaaatctctggataacata

SEQ ID NO: 6680 - DNA, 3015 bp, Homo sapiens
gacttctattttctaaaagcaactctactgggagacttatgctgaggaaagtatgtggttatcagactcagtgcccacggtggatgactcttaaagtctttttttcttccttttcttcttttgttttctttgtagagaagggatctcgctttgtcacccaggcttgagtgcagtggcctgatcacggctcactgcacccttgacttcccgggctcaagcgatcctcccaactcagcttccccaagtagctggaatacaggcatggctaccacgactgactaatttatttatttatttatttattttagatggagtttcactctgtcgcttaggctggagtgcagtggcacgatctcggctctctgtaacctccgcctcgcggattcaaacgactctcctgtctcagcctccagagtagctgggactacaggtgcatgccaccacgcccagctaatttttgtatttttaatacagacagagtttcaccatgttggccaggctgatctccaactcctgacatcaggtgatccgcccttctcggcttctcaaagtgctgggattacaggtgtgagccactgcccatggctaattttgtgtgtgtgtgtgtgtgtagagatgaggttttgccatgttgcccaggatggtctcgaactcctgggctcaagcgatttgcccgcctcggcctcccaaagtgctgggattacaggggtgaaccaccatgcctggctgactcctattaatacattccaccaaaaccattattttataaaagatattagcaaattttgagtttatgtgctttggctagtttctttactgcagaaactggctccagccaaacctctgtttaatttagaattcctttctcggctttccctttttgtacggctaaaactgagaatgatccactgcatagagatggaaaataagtgagataaggttgtgacattttaatagcaactgcttaatcacataaatttttcgtaatcttaactttcagcctctgtattgtaacttctgtcagctaagacttttctgagaataactcaacagtttcaaaatgtattgtcccattcaaatctttgtcaagagcagtactacctctctcacgatgttgtttcacatctgaaagttaaataatgcacaaatatcactgcatcctcccaaaccaaagggaaaggggagcatctgccagctccacaagatcccaatttgaagtccccaaagctttcctccaactatattctaactagtcacagacactaaatcgtagaacagaaatgcacctttgaaaattttcagttcaacacctccattgtacatatggggaaatcaggacataggttgtcagatttgacaccaacaaacaacactgtggacaagacaaatctccaatctccaggatctattggtatacccaaatagcttcgccttccttcaaaattttaccaccttatcacttgacgttaggagttcgaggccagcctcaccaatacccatgtctactaaaaacacaaaaaaatagctgggcatagtgtaatcccagctacaggtaaagacatgagaatcgcttgaacctgggaagcagaggttgcagtgagccgagatcgccccactgcactccagcctgggtgacagagcgagactccgtctcaaaaaaacacaaaactaccaccttagcccccaacctacttttccacgcatctttctcgttatcctttaaacagattatttctcagccaaacaaacgtcgctctttttctaggtacagctttcttcttgcttccacacctatgtcagaacagttatagcctctttatcctcccttaccacttaaatcctacccatcctttagatttatccccgttttccaaacaattcctattggctcaaacattctgcttcggaagccctattctgacttggcaggcctatggcagtctgttaacttgactttccgcttcgtgagaggcttaggctcggataacccgttagtaaccatgcagaggtgaggacccaaagacaggaacactagaaagcagaaactatcctaagagcccaccgaatttccgcttacatgagtaaccgagacaaccgtcagatgcgcgtgcgcacaggccccgttcccagagctcccctcgccctacgagggcccggcgggccaaaacagaggcccgccccgccccaccccacgcctcaccgcgaagtagcccagccccaggactgtgaccagagagggcaagggtcttgctggacggaaataggcggtagccgcattgctggcctccgacttcaccatcctcttgaaaaacccagacacagagttggctgggagctccccagccgtccccgcccccatataagaaaagcctggctagccggtttctcagggccctgggcgcccgcccaagaccctggcggaccagtatgcttgctctcattgcggagtctggtcccctcccctccgctcctagcgcgcgggagtcgggattgtgcttgcacgacttcccccggcccgcggcctgtgagcccaggtcctggggtgaaccgagcgctcgctcgttcgtcagaccgtagcgctccagcggctgtccttactgtgtagtagccaaagctgagggtgatgactgtgaaccagaacagactgcctcgctgaaagtaggtcgcgccggctgccgtagccatggctgcaacacctccccgggagcgcgcttcaggacaccgtcgagcgcgagcgcggaggcagggccggggccggcccgcgctccctcgccatccccgcagggagaagatggtgctggttgggaagtccctgagagcgagtctccctgtctggccccagtacaggggccttggaatcacacctgggctcagagtcacttggaactcttctgtggcatctgaagcagatggacgaagccaagagggccgagagtatctcagcacctagaaatggacaaggctggttattagaacaaagatttcgcaggtgaggcaagaatctgcatcaaagag

SEQ ID NO: 6681 - DNA, 570 bp, Homo sapiens
agggcgggcccgcgagggctgagcggcgcgggctgtcacaggcgcccgaagcgcgctgcaggtggcaacttggaggtgccgccaccgcagctgcgggaggagcccgggtctggcggccccttccagcctccaggagctctttcccgccgccgagcccgagactggaccccggagaattcgaaggaaagagcccctgcggagggacctgtgagcagccctacctctctctgcccttgcgctactttttttctccaaggaaggttgtgcctgcgggctgcgaacaagctccgggaggggccccaaaggaaggcttcggtgactcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcaga

SEQ ID NO: 6682 - DNA, 2348 bp, Homo sapiens; identical to SEQ ID NO: 2357

SEQ ID NO: 6683 - DNA, 357 bp, Homo sapiens
atggcctccacgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggggggtttatcttggtgactttgggatgctggtttcactgtaggtataattatgcaaggcaaagaatccaggaaagaattgccagagaagaaattaaaaagaagatattatatgaaggtacccacctcgatcctgaaagaaaacacaacggcggcagcagcaattga

SEQ ID NO: 6684 - DNA, 678 bp, Homo sapiens
ggatgattaaattgaaggaagtgttactgcatgtgagttagaagtaaatccacatggccctcattactttggcttgaactttaaaatttttaatgtactttgtttaatccagtgatttggcagttttcttgttgcttggttcttttttgcattcacagcagagctgtgtgtaaaccacttgacacactccctaatgtcctagtccataagtgtaaaaactagaggcataaactcattcatttttagttctgtttcctagcccagtgcaggtgaggattaaacatggtttctcactctgttttttccatagtggtgtgtttgaccttagtgttgagaatagttttgagtcactcagaagagagcatgggaaggcaacagacattttgacccacagttagcttccggtttgagatttctctttcctttccctgcagaaaatcacctctttatgataactgctttctccatgctcctgatggacagcccctctgcacttgtgatagaagaaaagctcagtggtacctggacaaaggcattggtgagctggtgagtgaagagccctttgtggtgaagctacggtttgaacctgcaggaaggcccgaatctcctggagactattacttgatggttaaagagaacctgtgtgtagtgtgtggcaagagagactcctacattcgg

SEQ ID NO: 6685 - DNA, 578 bp, Homo sapiens
agctctgctggagagacctgaggcttgcagcgctgggcccggccgggtcgctgcggctgggctggaggtgaggcgaaagaagggcatcctctgatgggagtggaccggagtccgctaaagcgaagcattccagggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaaaagaaaaatttgaaacattaagggaaaacagttgggtaaaagatccatttgcttttcgacaccctgaat

SEQ ID NO: 6686 - DNA, 631 bp, Homo sapiens
ctagctggggagggagaggccatatgagtggagggacctgtggaggaaaaattattattactaccttgatgtccgctgaaccaaagtggatggaaatttctcaggacatattcatccaaactacaaaaacaggttactccatactgattacaggatgatttatcacacattcattaaatatagaacattgactagcaaccagtttcctccaacaacagatccatttggaaatggcacactgtagaaggcaatcttgtgacttccttctagttgtatataaaaaatacaaatcggtcagggagtcagctcttctacaggtctacttaaactttgaaagatgagattgttcaaaaatgacacgagaaaatcacccatcaccactaagttaaagacttgaatatgtgagagttccagagcctcaaactcctactacagtcactgatccataacattttcctcttgcaatggactccacgccaaagtagctcagtcttgcggcatgtttgtgcaccaaaaagtaggtttcgaaagatccagcactagtcatcactgtcactgccagactcactcaactgcaagtcatttcctatttaaaaaaaaaaataaagtaaaatcatagaatcaaacaaaa

SEQ ID NO: 6687 - DNA, 523 bp, Homo sapiens
cctttgttttgttaacagctttgtaatattttctgtccaggttctgtgagaataaacatgacaatattttgaaagcttttcatatccccagaaggaagaaatgacaaagaggcaagccattataatgaatgcttatgatctttatttaggaacatgacagtctcaagccctctgtcacttctaagtcttgatgatttgtctcatttgcccagacccctcaccagtccacaaagatgggcagaatgaggccgacagtgcaccagaagacctccactctgtggggaccagcaggctgctctatcacatcactgatggtgataacccactgctgtcgccacgatgctccatcttcagccaaagccagagattcaacttagaccccgagtcagccccatctccacccagcactcagcagtttatgatgccgcggagttcttcacgctgcagctgtggagatggcaaggagccacagaccatcacccagctcaccaagcacatccagagcctcaagcggaaaattcgg

SEQ ID NO: 6688 - DNA, 1600 bp, Homo sapiens
aggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccagggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctag

SEQ ID NO: 6689 - DNA, 864 bp, Homo sapiens
gactcgctggggcgcggagccgagccctccccttccttaggaagctttcgtcccctccgaaggttggaacgctcatcccgagccagaccgacaaggcgtacagtctgcaggcctaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatg

SEQ ID NO: 6690 - DNA, 1878 bp, Homo sapiens
gtcttcctcccaccctccctgagagtgaaagggccccacagagaccatcaggcatggatgctgaactgctgggaagggagctcaggctttttctttttagtccccaagagaagaattctttctcagatgtttttgtggttggagaatatttttgccattgctttgagaagacttcccctcctaactccccctctttccttggaatttccttccttaaatggaaagccttcaacattcactccaagctcgcccttttgctcccccaaggaaaaataacaagcaaacagaggtgcttgcccagtgtctctggaggggcttcccttagagggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccg

SEQ ID NO: 6691 - DNA, 638 bp, Homo sapiens
ctcgccctgccgccgccggtgctccgtcgccgccgcgccgccatggaattcgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactttttcccatagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatttttggaaaaaaaaaaaaaaaaaa

SEQ ID NO: 6692 - DNA, 762 bp, Homo sapiens
gaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggtaagaaagtaaagtgtaattaaaatggaagtgctaaattcagaatatgaagtatgtgttcatgtttcaggatattctactttggcatgtaattgtgtaaattattaaaatattataattagagctgggtgcagtggcttaatgcctgtaatcccggttatttgggaggttaaagtgggaggatcacttaagcccaggagtttgaggctgcaatgaagctatgattgcaccactgcattccagcctgggctacagagcaagacctcatctcttaaatttaaaaaaaaaaaggagagaaaaaaatgctgggcaccttggcttatgcttgtaatcccagcattttgggaggctgaggtgggccgatcacttgaggcaaatcaccagcctggtcaacatggcaaaaccgtgtctctactaaaaaaaaaaaaaaaaaa

SEQ ID NO: 6693 - DNA, 572 bp, Homo sapiens
tccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgagtaagtttgaaatatatggaaaataaatttattttgaaggaaa

SEQ ID NO: 6694 - DNA, 911 bp, Homo sapiens
caagctggaaagagatcttgaaactttaggaaagctttgcagtgtacgggtggaggaaaaggcttggaatgttaagggactgatataaactcagttaattggcacatagctgaggctggtatccacatttcttaactgaaaacccagtgtgttatttaaccaagcagggtgccaacagaagtgagatcaagctcttcatttgggaatagtatggcataagactattcaaatggctacataatatcctaatagtggtggccatcagacactctgaacagagatccttgatccagccatccatctccttccagcagcagcatgtattgacttcttgtttccccagcctgaactgacatcaactcccaatttcgtggttgaagttataaagaatgatgatggcaagaaggcccttgtgttggactgtcattatccagaggatgaggtatgcaggatggagtgctagcctcttggcacccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggag

SEQ ID NO: 6695 - DNA, 1516 bp, Homo sapiens; identical to SEQ ID NO: 2313

SEQ ID NO: 6696 - DNA, 943 bp, Homo sapiens
ctcagaccgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgctcccactggcctgcgcccactgtctggcactccctagtgagatgaacccggtacctcagatggaaatgcagaaatcacccctcttctgcgtcgctcacgctgggagctgtagaccagagctgttcctattcggccatcttggctcctccagaataaacctattttttgaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttag

SEQ ID NO: 6697 - DNA, 1039 bp, Homo sapiens
ccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgcggagctctggactgggattaagaaggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaat

SEQ ID NO: 6698 - DNA, 1286 bp, Homo sapiens; identical to SEQ ID NO: 6021

SEQ ID NO: 6699 - DNA, 604 bp, Homo sapiens
gatgactcactgctgggctgctggaaagataattgcactccacctttgctggagactgggggagggacccttgggaggttgtaattttggggggcagagatggtagtgttttctgttatggaaacaagatgctaattagaccctaaggggaaacagcccctttccccttcctgggtcatggttgccttgaacccagaaatgccctccctgttctgggagcctccggactccactccctgtcctgcccctgaccaagccttcggcgttgaggaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaa

SEQ ID NO: 6700 - DNA, 882 bp, Homo sapiens
ctggtccggacctgacctgaattgcgaccccaacctggactgctcccctgaccgcaacccctacccccgcccaccagtatggcccggcacgtgttcctaacggggcccccaggccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaa

SEQ ID NO: 6701 - DNA, 2303 bp, Homo sapiens; identical to SEQ ID NO: 2638

SEQ ID NO: 6702 - DNA, 6565 bp, Homo sapiens
cagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcgaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgggcacaaatgggtaccaggcacgctaattcaaaaggtgtgtgtttctgaggctagaaggccttacataaaggaccacatgtggctactttggttgctactcaattatgctgtcaagcaaagcaaatgctagtgaaatttatttttagttttcttctgaagaaaaggttcaatgaaagctgaggtcaggcttggtgtggatattttaattcaccatttagtttgctgtttgcttacacttaggttagcattagatatacttaatcatgatttttgagtactataaaacgtgagaaatcttatttcctagtggctggaaaaacaggctttttaaattaaaataagtaaatatatcagtaagctagaagctatgcaataaggctttggctatggtattacaaattttcatatttcatgtattgaatttttggacaagaaaagacagccttgataggtattttataaccattaatacaattaatcaaacattgtttagtaaatccaatcgtctattcattattatttttcccattaatcttcagaacagctttaagttaatacagatgactcagaatgtgtttttcactcagtttcaaaataccattatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaatatttatctttaagataaatgcaacttgctataaaatgatagaaatgaaaaattttagaaaatcattttctactcactattttatgcctgccagttatcctttgttagtgataaaattgtcttttatgggaacgaatttgttaaaggtagaaaaaaaactggtagtgtatgtatgttttatagattagacactaccaaaattatttaacatttagaataattaacttgctttcaggatgacagatgacttaagaaactgatgaagggttaattaaggatattgatttttagggcagaactacaaaattatcaaatcacttaacactgtaaatatgttcctgtttcaggttttcaaagtaaataccttaatcaaatttggaaatagtatttatggattttattcaacatagattatctattttgttaaaattatagaaatgaacagttcttttcccatggatgccttttttcatcttggcctattctgatcctttaagaacaagctttgtcctttcattaatacttctcacctataattacgaattttctctaaacttgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatatatgtttgtttctatttcttcccaccttcccttcaatcttaaaacaagtgtttattaataagtcagaccaaagcaaatttctatctttcacagagtaattatcataggaacaaattactccctgaaaatggtggaaacttctttctccctccgaaaaataaactttcaataagtgttttctctctagccaaagtaaataagttcttaaataggtaactctcatttgccatccaactcattctatatatttaaataaatgtacttacacttgtgtataggatttaaaagggggaaacttaagaaggaagaaattgtgtatagaatttaaaaaggaggcattatattgcatgagtagaatgaaaagtatctaaccagaaagcaaataagttaaggattatattatactgaaatattttaatacaatttaaatatttcattactctttcactttatttgctatttgtagatttcagtattgtaatgttggcaagtctatttaagacggcattaataaaaattttgtttttcaggcatgtgataccaagtccctttccattatagataagtaaggcctaggttggttaaaaccttagctaaacacaaaatttgctagagaatcaacatataagaagctctaactccaagcttattcaccccagatatttcaccaatgttaacacataccctattgaactaagaaaggaattatattactaaccagcagagggagccaagtcaatcatgaaaggtaggagtataaaggaacatcatatgacttcctgttttgaatttaactgtatggcccctgctcactttttgagtttaccaaaaagacagtcataaggagagaaaggcgaccaatgtatcaaataaggatacagtgacaattataacttagaattaccttgcaggaaataaattggaagaaaaattgaatgcagaactatacaagtgaaatgtctcagtattataacccaagatggaaaaaccatggaaaacagtaccttaatgccatgatgaattgctagccaaatgtaacagtgaatatttcttaataattccattttcacttaaagttgaaattaggccataaatagacacattttaaaactataaagttgtacatcaaatttatgtgcatttaatctaagaaataagggataaaatttaataaaaaattattacagtgaattaataaggacatgatttttcagcttaaaattagagaacagaattgtttccactactgtttat

SEQ ID NO: 6703 - DNA, 483 bp, Homo sapiens
aagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataaggtttgttgtttcttctcagctctttttaaaatgtattgcctagtgtaattctaaatgcatttttcttttttcgttaatgttctgaaaaaaactttttaaaaaactaaaa

SEQ ID NO: 6704 - DNA, 452 bp, Homo sapiens
agagtcaggaatcagcttcctggccttagtgttcattgcaatccagacatgttctgagttaaaatccattgtcaaaggaatgtgacatgggggctggtatacaggttcctctttaatttgaactttatatgctatctgaaattgattaaaacttttattaaggtctttgtgttttttaaaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagg

SEQ ID NO: 6705 - DNA, 723 bp, Homo sapiens
tcgaaatattttttgaaagaggtaattgctatatatctgctttccttctaaaatatttcaaatatatctggtggctactgttttatgtatggagaaggtaaggcattgagattaactttctcatacttacaaaatgggctgtgtgtggtgctgaaaataagaccggtgtcctgactcccagtttgttttctgtgtattagaccagactgcttacttaaagttttattgcgctaaaaatctgttcataagtttgagctccatttttttctgtccattattacaacatagagaagcacattcatatccccagagaaatttagtgatatgcagcaactttgtttcactcttgacattaagtgtacattgttaacattttttatcttatgattgaatgtttcaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaac

SEQ ID NO: 6706 - DNA, 314 bp, Homo sapiens
ctgccagcgcctgcacaagagaccctaagtaagaaaactgagattggctgcttttacatcatctctacccatgtgctgactcggcatgtatcttcagccagggagcttcagtccaattgcacattctcctcgatggctctccaaggaccccggggattcagggaacccgtccacttacattctctttagtaattatggctcagcaagcatgccaccaaaatcatctagaacccagagactctggcaaccccatataagtaaaaatgtgtagatcaggtttttttctccaataaataataatttgacaatccaat

SEQ ID NO: 6707 - DNA, 1600 bp, Homo sapiens
acacagaacaagaaattttattatctccaatgctggtgcatgacaaataacaagcttaattagaggaggagacagagggaaacttcagataccaaggtaatttctgggcaggtttaaaacctttaaaagttgatagaataactgttcataaagtctttttagatatagcgctttttacttgacaacttttattaacagttcttacaatatgaagttcaactaaagtccttcatctgtcaagttaaaacagcaagcaaaacaaaatttctctagtatataacagcataagcaatggtttgttttctttgtacattcacacacatttagtgtctagatttgaaactttttaattaaggatgtcttaatttttgacttttaaaaatggttatgacaatggattttcttgatttatagatcacagtggctttataaatgatcaagatacatgtacaaacaaaatttcagatgctcttggaaacacatcttaagatacaaagcacacgtgatacatatttgagtttactcatccatttatcttacactgaaaatgtagcctttgataactgtggcttgactagatcacaaaatagaattttccaagttttcttaagctttcagtccaaataactcaaaagatatgtgtcctagttggatacatttttttctcattatataattagtatcagtgggcttttgtattggcagtttgtcttggtcatgacttattcttgcaaaaccatctttacagcaaacaaatatgaaagatattttccccaatgcaaggaaaataatctggatcaataacaaagtcaaagccataggtgttttaggacgttcttgataattgatttcaacggtcttaaaatcttttttctttttctttaatgattctcttcctttttcacaactgtgcagtcactgtcctattgtgttctattctgaaaaacaaatttttttgaaggtcaagtttttcaatggcacaaaactatttggaatgaacccaaaagatagcggaaagttgggtccctcctcaagtagtttcctcctcttttaacagcatctaactactctctatcaataatctcatcacagccgagttcttcggtcagacgattgacaaccatcagtgaaaaaagctcttcgataaaagctaactgatcaaacggggtcttctcataatgcatctgaaacccgccatccagggctggttctcttgttctcagaaacatcttgtcggcttcttcaagagcggctgatactctgtagccggcaccactgagctgctcctcttcgggatagtcgtagtcgtcctcccagtcatcaaattcctcgccctcgtcctcgctctcgaagtctgcgcccgccacctgggcctcctcctcctccattgggccttcctcctcgagctgttgggccccgctgcgggagggacgcagggatagctcccggctcccgctgcctacctccatctgcggaaggtcaccctcgccaggcatcacatccatctgcaggtcactgctctcttcatacagctcggacaactcagccatttccgacattgtgcaaaccgctcaacctctaggaaaaagcttccagcaag

SEQ ID NO: 6708 - DNA, 1071 bp, Homo sapiens
gcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccaggtatgtggggttgtaggcccgttctgtgtcctgaggggctgtgatcctatcaggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccaggaggtggaggttgcagtgagccaagatcgcgccactgcactccagcctggtgacagaacgagactacgtctaaaaaaaaaaaaaaaaa

SEQ ID NO: 6709 - DNA, 2730 bp, Homo sapiens
cagtggctcacacctgtaatcccagcatttcgggaggccaaggtggccagatcacttgagtccaggagtttaaggctgcaatgagctacgatcgcgccactgcactccagcctgggtgacagtacgagatacaacagatgaacacacttcctgtttatgtgctttagttcctttgtatgtgcattttagaaaagtcagaagtctttggtactttgcagcatgtgtgcattggtacaacttctaggaagggcaatttggcaccatctatcagatttacttatgtgcaaaatgatatgtacaagtttattccagcctgatttgtaatagcaagaagaaatggaactagcctgaatgtccctcaatagagtactggttaagtaagtcatggtatatacccaaaataaaatgtaatgcaattaaaaataaatttaagaagagcaaggaagctttccatatatgggtgtggaataatgtccaaaattgttaagtgaaaaagcaaaattcatatcatggttgagtatgtgctcatttgtataaaaagagggtaaacagaatattccaggaggatatgcaagaaactgttaacattggttgcctttggcagctgaagggcgaggtgagaggagactttccactgaatccccttttacaccttttgaattttgaaccaggtgggtaaataacttagtcaaaataaaataaaataaaataaaataaaataaaattggtggaacaaaaataaaaaggtgacttgatggaaaagaaaggagaaagaaaaggagtaaaagacatagggagctacatatatacattatgtcatacatacatacatgcatagagagatgtttactgctttaatctgggctgtcaccctgactcaccttacggacttccttttgctccctcctcttttgcctcatagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagcgaaagaatagaaggtgatgacaacactgcatatatttcagttttatttcttccgatctactaattaacatttgttgggcagtagccataaacaatcctagccaatgcaaggaaacaccaaatattgtcaagccctcacattggtcataactggaagcaaacatgacatatatggactatataatcagtttgcgtgggctacagcaagatgttgcccaagagcctaggcatgagctggcttcctacggcctccaagcaggaaagaatggagctatacacagtcatctgaatatacagaagtgaaccctgggccagccacattcagccgtaacttccccagactgtttctacaggtgcagtgtgccaatcagaagaaaggtggccaggctcaggagaaaggacaggagagtgactctggcaggcttgctccattgtagagatgagatacaccaagatagtgacttcccagcttttctccccaaagcacccctaatagctgagaagaatctggaggcatagctaccatcacagctacactaaccaccatactttactgtatccttcaggtgtctgtcctagctagttttgtggtctggctccttcagtccctgcaacaagcctgtttattttcattatattgatgaggttatagagcttggacaagttacatgacttttcgaagatcacatagctaataagtgtcaagagtcttattctcaaaaccctggtctgtccaactacaagcctgtgctcctgactccactattctgcttaccctaagcctaaagctgcccacttcaagctcaaatcctcttggaggcttcatgctttaaaaaaaaaaaatccatgcaattttttgcatcctaattaataatatatctgtgtgttttagtgtaaatttttttttttaaattaccaattcagttatttagctttttattccccaaatctttggtaccctaggcagatgtgtcatatttatcctgggctttatgtacctctggtttgagggactcttgaacttcattttaagaaacatggcccaatgagtacacagtcaagtcttcatgtccctgaacactgcattacaaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttcacaaataaga

SEQ ID NO: 6710 - DNA, 797 bp, Homo sapiens
acactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtgataaatctgttcagataagctccttatgaatccttcagatcgatgttcttgaggaaaacagtcaagctaaacagcaatgatgacttttatggtaaaggatgagctgatcactagctaagctacttagtcaccatcctgggagatgagctcacaggcaccaaggctttgcttcctgtggcctgctagttacagtgaaccagctccatggattgacaagggtacacaggatgacagcagagcaaaggagtttgccaagtatttgttctgtcattaagtattcaaaagaacatatatttttcttcatggaacataactttctaagaatgaaatttggggacttgaatgattcaaggtcaaatattaaacattagctccttcaccaa

SEQ ID NO: 6711 - DNA, 1005 bp, Homo sapiens
gtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagaggtgtggtcctgtattagagacgtttttgaaaaggacagctgattacgcaaatcagttttctgctcctttgattccagcatttgtaaatgaaataagataagtaaaatttatatccccattgcataaacatactgcattttcttagggttagagccttgtgtttagtaacctttttccatctttgtaattttcattatctgagatttttcatccaagaggaagtgtaagaaatgtatttttttccagcaatatttgaaccccccgtacatactgggcatatgtatttgtatctataagcacagaaatctttgggttcatctggccttgcttatgaaaactagacaaggacagtggtgtgatttaacaatgtgctttgaaaatgctgctccctggttcactctctgccaacccaccactcccacaatagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagc

SEQ ID NO: 6712 - DNA, 632 bp, Homo sapiens
accaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaa

SEQ ID NO: 6713 - DNA, 526 bp, Homo sapiens
gcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaaggatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatg

SEQ ID NO: 6714 - DNA, 1188 bp, Homo sapiens
gtaaagataaaatagggctattttaaacctcacaaagaataggattagaggtcagaattgtgatttatttagttctttgggacttgaacaccattgtcatcattatatctttgtgtgtaattgcaagcattcttatttaagatttttattaaaacatttttcctgaaaaccactttataaaataatgaatgtatgtgtgattatcatcaaaactgtagcacacctttcatggcatacccctcaaaggtgcattacccgttgtttttttcttagctgaaaaaccttgcttctgtgtcgttcttcaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtac

SEQ ID NO: 6715 - DNA, 2679 bp, Homo sapiens
cttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagtgctgggattacaggcgtgagccacgtcccccagccagtttcttaatctatacatctagcccagtccatgcccctgtttcagactattatatccaaccacctgctatacatctcataaaggtatctcaaacacagcatatctaaagctgaagtcatcatcttgccctggtttttcctgtctctttgctgatggcatcccatttacccagtcattcaaactggaaatctaaaagcctcacttagcaagagtttggaggcagaatatgataaagaacaaggactctgggaggccaaggcaggtggattgcttgaggtcaagagttcgagaccagtctggccaacatggcgaaaccccgtctttgctaaaaaaacacaaagaaattagctagacgtggtggcacatgcctgtagtcccagctgtgtgggaggctgaggcaggggaattgcttgaacctgggaggtggaggttgcagtgacccaagattgcatgcaccactgcactccagcctgggtgacaaagcgagaccctgtctcaaaaaaaacaaggactctacagatagatagacatcatatatcatattagtttgaatcctggctgttagctgttagacttgggcaaataatttaacctcaactttccctatctataaaatgggaattaaaatatttgcaccttatagggttattgtgaggattaaataggaacattgtataaagcacttaaaacagtacctgggacatactaagtaatataattgttaactcttactagcattctgtcccttttatttcctaaatatctctcatgcccatctcctaaatatctctttcctaaatatctctcatgcttttggcttaagacctcttttcctccttatctattgactggactgcggcaaatgcctgctaatcgttatttttgtgttcattcatttagcaagccaatttattacgcgcttagggtgctgccagggctacaaaagctgttgagactgtacttgatatgaagaagcttgctgattatcatgggaagactgacataaggaagcaccataaaattctgctgtatgagaggtatacacgggatactgggggttaataattgagggtatggtccattcaacatgagtgagacagaaacaattcataaaggagatgaaatgtcttgaggaatgagctcttagaagaatagttttcaaatgagtgtgcatcacagtcacctgtaagacttattaaaacagatcgctgggccctacacccagaggctgtggttcagtaggctgtagtaaaccagtaatttgtatttctatgacgttcccaggttctaatgctgttccccaaggccacaccttggaaaccaccacattaaaatacccagaaggcattaattcccagtccttcctctacacagctgcaaaacaatggtcctgaccatttcatctttgcactacatccttcactgtctctcttttgcccataggataagtacaaactagatctggttactgcctgccccaccagcctcagcatctctcacaactaggactaactttttcttctgacaactataaaatatttcccttgccttctcaagtttgctcaaggtcaagttatgccttttgcctggaatgacttgacttctcttttgttttacttagctggctgcttttcatcttgtaggttaggtcaaggactccaggaagtcttccctggacaagtaatgaagagggcataatccaagggccaactcccatgtttggaacctgactccattttcaggcacgtaatattgtcaaattccttttaaaagcacctgtctgtctgttaacgttggtgcagatactgctattcccctcctccataccattgctgatggttactgagggtatgggaagggccgactagtccagctgttcacaaacagcccttaatgtcaaactgaatactgccaacgtagttccagtttctgtatctaaagactcagcttggagtcacttgtctggactaaaagtaacccctccttgtctggtttgtgactttctgtactctgatgcccccagctttctgccttctagaaatttgtcagaatttccaaaattcttgggccttccttcttgctctatatatggttttggattcattccttttaaaaaatatttactgtcatttcagtagaattttgacacaataaatataagcacatc

SEQ ID NO: 6716 - DNA, 561 bp, Homo sapiens
aatgcgaggaatgcaccaggggcagagtccacacagcccgccgcggctgccctagcgccttccctccccagctctcgccgcgcagccagaggtcaccggagcatcttcggagctggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaag

SEQ ID NO: 6717 - DNA, 578 bp, Homo sapiens
caagaattaattgtttaagaatcaaggaagtacaatagaatttcaggattctgatatttattttgagttgttcctatttttttccccaagagggactatttggatttagattaaatgttgaaatacatgaacatattataagttatacttactgtttttatcattggcactaaaaaataatttaaaacagtgtcgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacct

SEQ ID NO: 6718 - DNA, 2049 bp, Homo sapiens
ttgggtggcctgggcggcgttggtccggtgcgtcctgttctacagctatggccgggccagctgcagctttccgccgcttgggcgccttgtccggagctgcggccttaggcttcgcttcctacggggcgcacggcgcccaattcccagatgcctacgggaaggaggcggcctgagcacgctcactgacaccgtttggcggcctgtcacccgcgtggctggggcacctgcagaaactgctgtcgctgcgaggtgcccgtgtgggtcaccgctgtgccagggagagaagacggcgaggtcgcccctgggaggcagaaggcgagccaggagccagtcctggaagccaatgaaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggacattgaa

SEQ ID NO: 6719 - DNA, 3351 bp, Homo sapiens
aatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatccttcgccagatctggttcttgccacgttcctacagcttacaggcttccaagcctacaaactacgggtgacacacctgtaccaactgaagcagcacaatattctggcatctgttggagaagatgaagagggcatcaaccccttggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtgaggcctggccagggcttcaggagaaaagacagttcgtgccgtctccattcttccgtcttggtggctgcctttcactgcattccttagaccagtaacaccttacctcggggctcaatggtcctctgtgaagagggaatggactgagggaaagagttgactggctttgtcccaagagaccttgtgattttccccttttgtccagcagctctgccctccttcctctccaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgtaagagtttggggaatttcagggaaaggggaagaatccaagtcattttccagagacagccactgaggtgtgcccttgccccggccgcaggttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatg

SEQ ID NO: 6720 - DNA, 498 bp, Homo sapiens
tgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtggtgagtggggcctgagcccaggcagtgcttttctggtgactagctgagcccctgtacccgcccca

SEQ ID NO: 6721 - DNA, 423 bp, Homo sapiens
ctgtggagatccgcggaggccgacaggattcgttggctgccgtccccgctgctgtgcattggggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaagttagttttttgtacaaacatgtttttatagtccattctggccctcaatatgattgtacttgtccctgaaatgtgtttatcttgtcctttatgtataaagtatgtagactgatgtgccac

SEQ ID NO: 6722 - DNA, 753 bp, Homo sapiens
agttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattggtgagaggaagtggggacaaaattgaagggggtggagcatgactcaaagcttctccctggagagagagggtatttagaccaggcattcctagccctgaaaattcctagccgtacttgaagctgcagaaggcaagctgatctgagactggcctgggcagctggtctgggtttctctcacactctggtatctcaggctggcaggaggatgagtccttccatgcatctggccacagctaccaccctgggggaggaaggtccctgctgagcatagctttgtggtttttgcccttccagatgagatccgaaatggcccataccgacagctcttccacccagagcagctcatcactgggaaagaggatgctgccaacaactatgcccgtggtcactataccattggcaaggagatcattgacccagtgctggatcggatccgcaagctggtgagagtgtgtcttgggagggaggg

SEQ ID NO: 6723 - DNA, 3505 bp, Homo sapiens
agcggagccctccctgctcccgggcggctctggaggagctcggtgtttgcctctagcccttcgctaccggaggatcaggttcctcccctcctccccctccagctccggccgccgccgccgccgccgccgcctccttcttgcatgacacagcagaaccgcagctgctgcagcaatttcaagccatccgcccaggaagcgccgcaaccgggactcgggaggggtggagggggcgaggcagaggccgcggccccaggggatccttggccccactgtgcaccacacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgaagacagagtcttaccctgtcacccaggctggagtacaatggtgcgatctcggctcactgcaacctctgcctcctgggttcaagtgattcttctgcctcagcctcctgagtagctgggactacaggaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatc

SEQ ID NO: 6724 - DNA, 905 bp, Homo sapiens
aaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggtaagattaagattcctggagaaattcctttgtcccagtttatcaaacaagaacctaaatatttgttttctacccaagaagatactggtagtaaaagaaaaaaagcttaattttgttgaaatttggatgtactctgaggcaaaaggatctctagttattttcttctaatcatttagtgatatccccagtgttacatacaaagatttggatttcattggcatttctgccttctaagttcccatagctagttgacgtcatttttggagaaatgagcattagacctataagatttgtttgcttttttttttttttgtgatggagtctcagtctgttcacccagcctggagtgcaatggcgtgatctcggctctctgcagccatcacctcctgggttccagtgattctctcacttcagcctcccaagtagctgggattacaggtgccaccacgcccggctaaattttatattttaagtagagacggggtgtcaccat

SEQ ID NO: 6725 - DNA, 2467 bp, Homo sapiens
actagctgtgccctgtctcgccctcatagaccccctctagttcctacagattgactcctccactcactcttcccttgggggagacatcacgcctcttgcccctctgtattccactgtgtccacaggcctggcccaccttctcgtctgctccccgggccacccagccctcgcctgcaccccctgtcccctctcccatctttcagaaacccgctctgagagtctggcagcagcgggtccgggagtctggagccttgcccatggcgggagaacaaggggtctgtggaaatcatgagaaaggacttgaatgacgcccgggacctgcatggccaggcagagtcagcagctgcagtgtggaaggcaaggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtg

SEQ ID NO: 6726 - DNA, 402 bp, Homo sapiens
gcaaacggggccggaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatg

SEQ ID NO: 6727 - DNA, 1477 bp, Homo sapiens
gcaaggcttactcacttttgcacagtttccagttctacacctccttctcgttcctcagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacatggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttatcagttgaattactgggattaag

SEQ ID NO: 6728 - DNA, 539 bp, Homo sapiens
gactctccatttcttttccctccctagaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatg

SEQ ID NO: 6729 - DNA, 1496 bp, Homo sapiens
gtccctcccaacccccgggctcccaagttctatctcactcctccaccttccctgtcctctcacagctgaggttccgggctgtaatgatggcaatgctgcccagcacaacccctgcccccatgatgtcagaaagtgccacagtctcatggagcatataatactgcagtataagggccacaaccacctcggaatgcaggacagcgcacaccagggcagggtgggccttggtgaccgcatagcccacacatgtgaaggagaccaaggcgaggatcccctctgcccccacacaactccaactcaggaggtcactgggcaacacgggggtctgcagcacaaagaggcctggcacacagcccagcagccccaccaagccagataggaaggccactgttgggaggcaggagggaaagtgcagagaacgatagaccagaagccccagggacagcgccaggcctcccaggaaagcctgcacatagcccagggtggtgtagacacctgtggtcccctcctgtagtgtccagagtccaggtcccagaatgatgattagtcctaggatgctgcccaacagtccacaccactcgtagccaccgagaccctggctctcaaggcagagggtgaggacagcggagcatacggtggaagaacctttgcgaacagtggcagcgttgccagcgggcaccacctgaactgcactgtaggcacatccaatgctgaggacgttgagcagggcacagaagcaggcccagcctcggatgtcaggaggtcccagaagggggtcgccacgcagtttaagtagcagggcaatagggaggtggaagaggcatcgacagatgagcagctccagcgagggcaggttggaaccctgatggacatttcacacaacgcagagctacgagaacatctcttatgctccttgccatgggattttaatgccccaaggttcataactacagcaaagaaagtaagtcaaaaataaactgagcttaaagaaggtggcaggccaattttcccaaaaagactgtggactgtgggctgctgtgtagcctttgctacaaggctgaggaagcagaagaaagatgaattgggcaattggtgatgaaaagtatttgccattttcaaaggcttctcagtgtggccatagattttgctagtcaatttttaaaaaattatatttttagctcaacacacagctctaaagcagggttcagtgtagtgtgttctctaccgaaatggttatatacagatggtatggaaatggttttaaagattactcataaactatccttttaaagaaaaactagactcggtcatatttgttaaaatgagcaatgtcaccaaacagaaatgtaggtgggaaatactgaaccacaaacatttggagttgcaggcatagactagcagagcatgaatagtcatcactgtttctataatactgaaacactcaaatctgtttctgaggtttaaaacacagagctatattatattcataaacttcc

SEQ ID NO: 6730 - DNA, 572 bp, Homo sapiens
gcatttttcttcatttctctgtggatcagatggtcactggtgtttagagtagttaactagttttctaatatggtgagctggactccaatacagggacatccaggccagttcacggagcagggaccttctcaccctcaccacttattccagaggtggctcatccccaggcaatgacttgagccatccctcttgtcccttggcagtttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaa

SEQ ID NO: 6731 - DNA, 865 bp, Homo sapiens
cactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggaggga

SEQ ID NO: 6732 - DNA, 552 bp, Homo sapiens
acgggcaagggccgccattttgactgagcaaccctagtgacaggagccgaagcagcagcgcaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgtt

SEQ ID NO: 6733 - DNA, 571 bp, Homo sapiens
ttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctgggg

SEQ ID NO: 6734 - DNA, 2487 bp, Homo sapiens
gtctggaggtatccagatgtgccttaacaaatgtaaatggttttcattcagaagtttacatttttattacattataaaatctcatcattgggaactttctaaaccatgaatatcagttcttttaatgaaatttaggtggtgctttatcattttggagaagttgctgtttgggacaatagcatcagtttatcaagaagtgtactcaccatgatattcaacaatgtgttacatttgacaaaacgtgtttagagtaagaaagactaactatactgtctgttatatttatttatgctttttgtagtttagctacatactataattttcattttaaacgttccttagttactacaaataatatttatgttttgcttcttcttagatgtaggcggatgcagaaatagaattatgttagagaaattattaaaagtttaattccagtaggcagttggagaaatctgaaactaatttgaaaaacttttatgctgtagtctcattagaatcattttaaaagcactgttcttgcatttttcctagactacagagagtgttctttgtcattttttttcctattctgttgtgaagtttattgtttcagttatttgagggaaataacctcttaatatgtttattttcctgaactaaagttttcatgtagagaatacaattaaatgttttgtgttatgacccaaactggctggaagtagagttcagagagggagaagggacaagaatcagtgtgggcatctcaggaaagtggcgccagtgctgggctccagccttctccactggcatgatgggtcctcagattctcctctggataatgagggtgttgggcactgtgagctctgacttctggggaggataggccatcatggactccatacacaattttgatgggtatcagttctcataaaatacctgctacaatttatttattttgtagttgtttagaaaactgtgagcagttgggcattagtaaattgtagttatatcttaacgatcttgggaatcattgaaatatgagtttttttccctcactcctatttatttaattaaaaaattagggaagttgttcattcacagctgtatattaatataaaatctctttataaaatgattcagagaaaaggcagtagtggtcacttactgtgctaaaatacctttttctctaaaaatatttaagctttagggtttgtcatagttttactttttaaattatactttgtgtaacaatttacgttaactagaaaaattagatatataataagttttggtactaagaaacatttacattctacactcattagtcaaatgaacttttctttcccagtgctaacagattttgtttcatgtgaagaaaaataaaatacaaatgaaataaaagtctagaaacagcaacaggaaactcaccacagaaataaagacataacccttgataagtttgtgtaagtgccagaattattggaagcaggtgacgaatgattaagaaaagctttattgtggggacatgctttaagaatcagctctgtatttgtgccaaggagatcaggtattggtgtgcaaacagatcccattaatactctgatttgaaccatgaattccacctactctgcgttgaagccctccagtagactgatagatgtaatcaaatgatcagctaccaagtttaattcctttgcctgtgtgtagcaacagttggtagttttacaagttaagttgatggtctggctgcagataagagaaagactcagtgataggtggtttgtgagtgaagtaacttccacactgtcaagagttgacagcatattaattgtgtggcattataattgtgagaaacaaatgagagcaaaatgttaggtcctttgacaagcattttcctcctgtttttaaaaagggctttaagttgtttcctatgtaaggtaatctttcttttttagtattatctaagaaggatggtagattatgtcattttggaaactattgtgtcccttgtattttaaatatttcaggaaaatgcctacgattgttacaaagatgtgtgttttacttataacataagctctgattctccagtggccactgggccttctctgtgctctgtattcaactgcagtatgaattacagaatgctgtgcatgttcgttagtaccaataccatgtgtatgtggtagaagttgtaaccagtttctggatctgtatggtactataaaatacttattttataattctgtaaccgtatggcagtgttatgccaaaaatgtataaagagcaatagtttttgttgcttactgctgtattttaaaatattgtttctaaaataatagagttagagttccttttgagtaattatttttaagaactattgccaaatatacatcctgtaaaactaataaaagccactccatcttagataacattttagcattgtgctagagtacattatggtgattttgcacgattaaaatatttttaaagaactagaaaaaa

SEQ ID NO: 6735 - DNA, 726 bp, Homo sapiens
gtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgagacggaatttcgctctgtcgcccaggctggagcgcaatgtgagccgatagcgggcaattgcactccaacctg

SEQ ID NO: 6736 - DNA, 2609 bp, Homo sapiens
agcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggatctccctaatactatgaacgcggcagagataacggacaagctcggcctccattccctccgctacagaaactggcacattcaggctacttgtgccactactggacatgggctttacgaaggcctgaactggctcgccaaccagttccagaaccagaactgatcagaaggatctattctttgtgccttgtggccacatcagctagcctctgctgtgtgcacgtgtacgtgtgtgctgggagtggaggcagctttctcacagtgccttatccatgccataagaaaagcagtgttacattttaagaaacccagtgttaagttttaaacaccaccttccatttcagtagctttgatgatcatttttgcaattgatggagaagtccagagggcttgctggtgctcgaaggccagagcgggcttcatggaggcgagttggagcggggactgagttcagctgttgcaatcctggtctggcgtctggagtcctgttagtctttggcatcctttcgtaaaaaggaaggaattgtcattcttttttttttaaaaccatatttttactgtaccttttcatgtttatttattttttattaaaaaaattttttttgaaacagcctcccactctgtcgcccaagctggagtgcagtggtgcgatctcagctcactgcaacctccgtctctcgggctcaagcaatcctcccacctcagccccctgagtagctgagactatgggtgtgcaccaccacacctggctaatttttgtattttttgtggagacagggtcttgccatgttgcccaggctggtctgtaactcctgagctcaagggatccacccacctcagccttccaaaatgctgggattacaggcatgagccactgcgctaccgagaaatcgtcattctttaccaccactgctgcagctagcagctcactcttcagtgctttaagcaaatgatcctcaggaaagaaaaggtatttgcttattgcaggtgcaaagaggctcagattggaacttttccctgaaactatattgtagcccagagttcctgatgtaagacgctttatttaaagacatccgtgagctttttcactggcatatcaatacttcataacactaggaaggtatccagccttttccttatgctagttccttcccttatttgccagatggggaccctgtggggaggtgacccagtgtgaggccgaagctctttcccagagccccacaggccagtggagggtcgtgtttgtgctctgggcatcaccgtcttgggtctcggtcccctgcgactgcagctgctacatccctccctgctctgagataaatgttcttcccatgaagcagacggttcacttttgggatggcgctgtctccaggtttggctgtctcagtccagatgatgtttggttagtttccattcccagaaccacaagcctttgagttctgaaagtttgtgacagaatcaagaggctaatttgggagatgtgagattcccagcccacctggtattgccctcgagttagtggtaaattttgctatggaaaatatctcttgtcaagaccaagctccggcgcattgcctccctcttttggatggccatggcatctcatgaaccacttggaaatgtgttttatgttgttctccaaatattaataaaaatatcccggagaggaggttca

SEQ ID NO: 6737 - DNA, 535 bp, Homo sapiens
cagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacaggtgatgacaaacacaaagagggacctatgagagactttttttcagtagatcagaaaaggaaaaaaattagcctttctatccttgtagttttgttcttataatagagcccaggtagttcaaaaggtacagttggcaggagaaagtcttctttcaaaatacccataatggagagaccaaaaaaaaaaaggaaa

SEQ ID NO: 6738 - DNA, 4734 bp, Homo sapiens
gaaaagcaaagcaaagccactcacatgaggtcttgctcctggggacgggcatggccaggactccaaccccggcagcctgtcccagagccctggagctagccccagtgcagtctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacagtgagtatcttcctggagggacagggagcagggttctggggggcggggggatttcagggcaggggtgtgggtgatacctcctcaactccatcaggagtgacatccaaagtatgtagcagtgggttgggtaccagtgccagagcaggctcctggaggccgctggctgggccgggccttgtgcctttagatgtggggaggccgggaaccccagggctggggccagggtgccggagacatccatgcccctggctgaatgcccgtcctgccgctgtctctcttctttccggtcagtggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatgtaagtaacccttctcccccagcagctacccccaggaactggggagtccctcccaagggctggggaggagccctatctgagccctgtcctgggagggttagtatggtatagaccaactgctccctgacccccctttcctagccgcaggcatccccgactttcgctctccatccaccggcctctatgacaacctagagaagtaccatcttccctacccagaggccatctttgagatcagctatttcaaggtttgtgctcccccaggaaggggcgtctgtgaggggtggggatggggtcacctggctccaaccctcacgctacctggggcatctggccctctggctgtctctcctacagaaacatccggaacccttcttcgccctcgccaaggaactctatcctgggcagttcaaggtgagatctttgttttgcagggggcgaaacaggaagggttgggggagggcacgcatgagaagccccgccaaggccctgcagacaaatattatgtagccattaagtacatgggtgctgggcccagactgcctcggttcaagtcctggttcctcgtgtcttcatcttacgaccttgagcctccgatttgcctcctgtgaagtgaagctaatggtactgtctgaagagggctgctgcgaggcttagctgactaatgatgccgttgagagcccgggaccctgcagccgggctgcctgggtgtgaatctcagctctgcagcttacccaccgtgtgactttggcaacacaatccccttccctgtccttcagtttcctcatctgtgatctggggatagcagtggtctctccccgacgcggctgctgtgacggttccctgggggtaaaacagtcacagtgcctagaacagttcctggcatgcggcagtggcctgtggctgttccctgcagtcgtcagcagtgctgtcgctcttccctgcagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctggtgagcctctggccagggacctgcccaggtggatttgggtgggggtcccctcctccccctgaccccctcccaaaggccacacccgcacacatctggccacctctgtctctctgaacagtgccccagatccatcctggggagaatggggtctgtgcccctggccggtccccactgctcccaactcccactgtggcctccgggtctgccattgctcccacctgtcctctctgcctccccatgtcactgtctctgtccgtccatctgtctccacctcagatatcgtcttttttggtgagagcctcccagcgcgtttcttctcctgtatgcagtcagtaagtggccccccagcctccccgcatccccaaccgccgcctccacctgtgctgggccccatgggggcagcctgggccctgcctcaggaaaggtcacctccccagctatggggggcggcagggaggtttgctgctgggggcgggggagggagcggtggcgcagcctgggcggaggctcccaagctcacgcccctccccgcaggacttcctgaaggtggacctcctcctggtcatgggtacctccttgcaggtgcagccctttgcctccctcatcagcaaggcacccctctccacccctcgcctgctcatcaacaaggagaaagctggccaggtaagagcccttcttcaagcccccgtcgtcacaggctcccccttccctctcacccttttcctcagagggaacccccactgtggaaccccagcactttgcattcctcagctcagaacctggggctctagaatccagaggggtcgggttccaggcctctgggacattcactgcccttttgagcaagtgatagaattccaactcaaaccagctgaagccagataggaaggccgggcttccagggactgaggaggtgggagggggtgcaggggtcaggagagacagtgcggggggcggggttgggtccacgctctgggtctctcaggtctgtttttcctgggcagcctcactctagggcaggtgctccctcctaggtgttcccctcaggggaagtaggcagggtcaccgggcaagcagcgcacgctgtgggcagacactgtcccaagtcttagcctgcgtgaactcactggcgccacaaccccatcgcggttttgtgatcacccctattctacaggaaactaagacacagagaggacaagtcacttgaccaaagtcactgagctggctgggcgcaatggctcacgcctgtaattccagcactttgggaggccgaggcgggtggatcacctgaggtcaggagttcgagaccagcctgaccaacatggtgaaaccccgtctctactaataatacaaaattagccgggcatggtgctgggcacctgtcatccaggctactcgggaggttgaggcgggagaatcacttgaacccaggaggtggaggttgcagtgagccgagatcacatcattgcactccagcctgggcaacaagagtgaaactttgtctcaaaaaaaaccaaaaaaacaacaacaaaaaaaaaacaaagtcacagagctaggatacaaacccaggccacctggctccagggtctgtgctcttagctctcccttccctgctcctgcccctgacccaccccctccctgacagtcggaccctttcctggggatgattatgggcctcggaggaggcatggactttgactccaagaaggcctacaggtgaggccccgccgggggttggggcagcctggaagggacagggtgaggtgggagcgggggcacgaaggcagatgagaggagcaggcaggggcgagcccgcctgggaactctgatctcctgctgcaccgcagggacgtggcctggctgggtgaatgcgaccagggctgcctggcccttgctgagctccttggatggaaggtgaggagctgagcaaccccagcctgtcctgagccccatccctggaccctctccccaccccatgggtcctctgaccccatgatgcacagtgacctttgacttctgtgacctttgctcctgcagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatcc

SEQ ID NO: 6739 - DNA, 866 bp, Homo sapiens
ggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacggtaacggtaattgtagacgtcagtgttggtgttaacatttcagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaa

SEQ ID NO: 6740 - DNA, 2161 bp, Homo sapiens
accaatgtaaaggtcaggccgaggccggcgcggagaatctgctgtcgcctgcagctgctcgcctgtctccgtcggaagggagcccaagctttgcagagatgaagtctcactctgtcgcccaggctggagtgcaatggcacgatctaggctcactgcaacctctgcctcctaggttcaaggaattctcctgtctcggcctcctgagcagctgggattataggcatgcaccacctcgcctggctaatttttttgtatttttgtagagatggggtttcaccgtgttggccaagctggtctcgaactccggacctcaagtgacccacctgcctcggcctcccaaagtgctgggatagcaggcgtgagccactgtgcccagcctcacctaatggtttcttagcaaacttcagtagaatgtttagaacgcggccctgataaacttgagtgctggtaggaggtgctacctcgctcaatctgtgagcaaccagccctgtgccctggatgcttggcgggtggagagaaagacagtgttatgtgggcaagcctccaactcaccagttgcagtagagcatctggctctctgtctgctgctatagccctgtgagtcagccagacgtgtggtccccaagccagcttcccacctagcacccttgttctgctacagctcccccacctgccctcctgcattgcctaggatcccacgccccgctttcagtctgctctgggacatctgtcttcttctttgcaggggactaagtatatgacttaatgaatcctaaaaggaaaaaaagatgtcaggaaaaaaaagtgcacacaagaaatgttgcaacatctcatccttagcaactttgtttggttagtactgcataactcacagcagattccaaggcacctgccttgaacattgctacatgctctaggcattatcaggaacgcagccagggtgcctgcaaagttgtctccagtttctgggtaagaggaccatcatccatattgtctgtggctttgtgtctgagttgggctactgagcctgtgacttcagaccccttgtctgcctgatggatacattctgtataatacgttaccatcacaatttcatgaatgtaactaatgaagatctagcccttccatgcctcctgctgaactatgtcacctgtgataataaaacctctacacatagcattttatacaaagcaagtcaaacagcaatgatagtggcaagtgatgtatttggcttaaagaagcttgtgttactgaagttaacgcagaagtctggcctccgtttgtgggattattaaatatatatcctacgggatcagagtcatctattagaaacagtgatagccctgggtataaataaacatttctttagagtttggcgtcagtttttcaatgtccatcctcaaatcagacagtctgtttgaggggtcagttttcagggtgcatctgcaccgagaggcttgaggcagcaatgacccctgggctgcagttcggttgcaggcgctggtggcgggcagtccaggttggagggtggagatgggccaaggtcacagatgctgcagggcttcctgtccttgctctgtgtaaccgtcatcgcggtgggtgtttgcccactgtccaaaggactcctggatgtgcacgtttctctgtgtgttggccaggcgcttcttatctcgggagaagaagctaaacctttggaagggaaagcaaacacagaaatgagagctgaccctttgctgtgcaagtcacgttttttgcaatgccggagacatatagcagcaaacttagaagggagcaaatcaattcaaggtgtgaaagacaaagttgggggtgcaggtcaaagttattccaagaaagcagcagggtattctgcgtgtcatttggacacggtaccttggaggtcacgcggtatgggcaaggcatgcatgctgatgtgatgtgtgaggtgtcttccacgttagccgctatggaggatttatcccgttaccagtggaaatcaaaagctgctgaaacaaatcttgggtttctttaattaccctaatgacgcagagaaaggaatacttgaaaaccgtgtggaatataagaggattctgttgtaaacgaatgagtatttctaatttaaatagttctgtatttgtttaatgtcagtcaggaaactgtggcc

SEQ ID NO: 6741 - DNA, 4802 bp, Homo sapiens
aggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccggcgcccaggagcgccctgggtatctcctggctgctctcccgaatccttgcgcgccgcgcccctaccaggttcactgggtgcacgtagccgttctcatagcggtcctcctgcaacagctgccgcagtctcgctgtctccgccttccgctccctggcggaggcggaggccagagagcgctccaaggaagactaaaaacccaggccgggaagcgcggggtgagaaagcgaggtgggtggcgagagcgtgagcgcccctctgctgaccccggggagcgtggactacgagttggcgcccaagtccagaatccgcgcgcaccgcggaaaatatttgcaatacctgccacgtccaaggttcagctgaggccaatgtaaagccagtattataggacacttctcagactgagagcccaatgtcgttggaaaccactgggccacaggaaaggcaggctctctcagtcctgctcctgccatggaagaagcctgctcccaccatgccttctgccacgagtaaaagttccctgaggcctccccagaagcagatgctgtcgtgcttcctgtatagctgcagaactacttcaaatcatcccaacaccagagaacactaaatgacagtggacaggaagacagtgtaccttttgctcctgatgatcgtaagaacaacctccttcctcttattgtgaagtgcaaggtgcaaaaaggaggcctgctgcttgttcaggactatgtcagcattgtggctcagaagaagcgcaacggctttggcgtggccttcccttgcagcaaagtgaagtgcagtgttcttttgaagaaaaacagacacagaaaacgtggtgacagtgtctaatctgtcttatttcactgcttaactgcttaaaagacattagcgacactatttaataccaaaatacatagcacttaaaactggtgttcagaatcaagcttcaaaataatgagtttatagttctagcatggtgtgtgtgcatgtgtgggaagtggatctgtgtgtgtgtgtgtgtgtgtgtgtgtgtgagagatagagaaagagagagagagagagagagagagagagagagagagaatgaattccaaggcatttgttttgtgttgcttttgcaatgggatgattccacaaggacaaaggacaagctttcagggtaaagatgttgggttgaacacagaagaaaatcctcctgagattgatcatttgtagaacagtggcttacagatttggggcttcacaagcttgtaaatgttttttaaaatcagagactgttataagtttgcccatttttagtttctccacttaaagactttttttttttgaaaaaggcaacaacagtcttctatccccatcattttatgaacaaacgtacatttcaaaagttactctccccaaaggaaggaaagacataatagcacaataaagggcagcatttcaaatcaatacacttcaaaataacacttatcttaatgaaaactcacccctgccttcatttctctggacctaccagggagtaaacgctttaccatcaaatttcattggcctgtggacctcgctgctctgtgagactggaggtttccccaacattcacccaccccttggtattctcccaattctgttgccttttgattcatacttcacctcaagaatccacttgctaaacacccaacaaaaggctgggaatagagcaaggaaggtaaaaggtgtctaggagagttttctggcaatgttggaagtttctgctatattgagattttgggtaagcatgaggaccgcagtacataccccgtcttcatccaggcgatctgtgcacttcaaattagtatcaagaatgaccttcatggtctgagtgtacccgcccatggacgcatgatgcaaagctgtccagccattgtggtcactggtaaagagttaagaaaagatgtgtgcatacacttaacagatgaaatgcgggatgggatgccacttggcttattctaggtaaatctgatgacaacaaaaagcattattgagatctggcaactaaatatttataaaacatttataataaatgagctaattccaagctcaatgatcttaaatgacctatttctaatgtgattcatacacgttttttacttagtggtttaaaatatgaaagtatataaacacattaccaaacactttggggtaggagaagtacgcttagcatgtctgtgtcatacctaatttttttaaagctataatgaactgatacacatcaatttaaatcttgttttattctttcaatgaacactgtatcaaaatttttttatgaagtaatgttagtctttgtggtcaatagttattggtaatactactagtaatatgatacatggctataagatgcttagcttagtgtcagttattattctaagagtttaaatctaaaaagcttccctcttgtgctctgaaaaatgcttactcaattgctttgaaaaatgtttatccttttccacagaaattcaagatgtaaatacaacaaagccttgtcatattagctatcttttttcaaattagacagaaaaaaattcttgacactatttaatttcagtgctagtgagcagatgttttagggtgcaagagccatgttgctatttcagttatgatgtaattaagcaacaactgtctggcctgggtctacttcggtcccctttgcaggtcagttgcttggtgtttctttgtaaaccagaaaaaactgagcaaaacattcattcatgtagctgtagcaccaatttgctggcatcaatattatggtaaggaaatgtgtttttgaacattagcctaataagctctttgctactgctatggtaagatatcaaatgaaaaacctctgtaaaacatttccaggttttttctttcttatcacaatatcatttaattatgccacatattttattatacttacatattttaactttgtttcttgtacttgagttcatttaagtataataaaattcagaaatttttaccatctcctgttgtcacttaaagggaactttttatgcctaccattcatcagattgaatgaaaagtagagtatttgaacttgtatgttttgtgtgtgtgtgtacgtgcatacacacatacacaaccacagttttgtatctatataggaatatggcagcatgatgaggtaaaatatgagaaactatgtttcaaagaaaggttctgagaaagactgcacaaagccaattattctgtgaacagaatattcttgaacaaggttcttcaacgctataaacttcaaagtctttgtcagttggaaataatactgacttccctttcagtatttttagaagttacatatgttttgatgaaaaaataaattggataaaagtacttagtgagatataaagttagacctcataattaaaaatataatgaaaagatagcctgaaaatggctaattaaagaaattatataaacactccaatcatatatcctcacctgagaaacaatgcaccttttttcagaagaagctgaactactttatcatgtccattctttgctgccagatggagaggagtcattccatgaaggtcaccttcattcagaagcctcgtatcacttatgtcttgtaggagcctctgacaggtattgatacgcccataacttggaaaaaattaggtttcatattttcaaggcaaatattaaacagaaagaagacatgttcatacattgctagactgacccttacctggctgcaaaatgcagaggtgatttcttatctttgcttttggaatgaatggacacattaaagccaagtaggttatttacagaaccagggcccccctgtctacatgcataatgtagaggagtacacccatcgttgtcttcatccattaccagctctttgatctgttgcatctataggaaaaaattaatatcatacaaataactctgctattatgctaatatgatggttttcaaactattctgtaggaaaatattttccaacaagggtcaatatgtattccttggggccaaaattgtaaataacctaaaggatttgagagtaatataaatatgaatgaagttgaatgctctgtcttcatttagtgtacattaccatattagtgtacattactgtattaaaggatctgagagatcatgccaataggaaaatgtacttaacatttttaactcagcatttttcaaatatatttgatcatggcccttccctctgcccctcctcttatttcctcccacccccaaataacacccaacagcttcatgttaatatgttctgttaggtaaaatggatgggatgtaaacattaggtttattttatgttttatatgtatagtaaataaaaaatgaatga

SEQ ID NO: 6742 - DNA, 587 bp, Homo sapiens
gacttgaatgaagctgacaccaagaaccgcgggaagagcttgggcccaaagcaggaaagggaagcgctcgagttggggaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgg

SEQ ID NO: 6743 - DNA, 3685 bp, Homo sapiens
ctcggcgtcgctctggactggcgcaggcgcaagccggcaagatggcggcggctggggctttccgtctgaggcgggcggcatcggctctgctgctgcggagcccccgcctgcccgcccgggagctgtcggccccggcccgactctatcacaagaaggtagggacaaaagagggacgcgcggaatgccgactcagcggaggcctgggctggaggggcggccgcggggttctgcgcagctaggactgggagctgtcccctcccacgtctttgccctgactcgctttcccttgctgcgcagtgaggctcactgcaactgataaacaacagttaccgctcatcgggcggcgacttccagggggccccgccgctggccgcgacttcgtgcgtcccaattttaaattcgccaacagcccaggaggcagggtcctgttgggacttgtctttctgagtccagggacagacacacccccggagcgggctccggcttcagccactccgctgccctggccagatgaccttgggctagtcactgcgcctctctgaacctgtttccccaggtgtaaatggggggctctcagctgtcccttacaaaggatactgtgcgtggagtcctggcatggttcctggcacataggccccagcacgaggagaccgtttctgttactgctttaggagtgcataggggagtcaggcttgtaaccaacatgcgtaatgtttttgttttgtttggggggttttttggcggggaaggagggatagattcatagtctgcagccccttgctgtctggtggcacaaagtcccccagacgtgagactcccactcgagaaacaactaaagaatgccataaatcaacgtggcacaaaaggcccctacattagatactatcctgaggtcccttttacttggagtcaaaatccttagtcagatggggggaaaaggggactggaagatcggcgtgcttactactaaccagtaaccaaacctcaaggttattaaggccttctgtgtgccagttcgaatggatgtttattgtgatctggcttctgccctttctccaagggcttcttcactcctccccctcccgggggtgtgttttgttgagggtacaccctgaagaaacttggactagcagcctttcagcagccagggtgcgctgctgcaccagggtgatgacaggctgtgaaatacggtaatggcactgtttttattttaaaagacacataaacgtacacattccatagcattgttccctgtgtaacagtcaccttaaggcttctaagaaagctttccctccctgggccatggttatttttagaatttttaaatagtaatcatcctttgaggatggattttatttgaaaataacaaaactgctgtttgagcccaagtctggtgatgtaggtgggtgaaagtcaagtatttttgtaaaaatcctatggaactaagacatgatttcactgatttttttttcttctaggtatctcaaatctgtgaagtattgtagaggagacacaaaaggaattgggggtcacaaatggttctcattgacatgagtgtagacctttctactcaggtgaaatttggtatttagtgattgcctgccaggttcaagatgctgaccgaggagcttaccatcaaaccagagaccagtaccaatagagagtgaacatgatttatcttaaccctctcattttaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaaggtaatactcacagcagaagagccaggtgccggggcagacacactaactcattcttcaggaagcctggtcagacctaagttctttccacttgatctggaattttaagtacccataaagaaaggtcatcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtcaaactctcgatcactagagggtgatgtggcaaatgccatcccatcaacagattgacatgatcttttttccaaagggcatgtcaacttttttatcatgacaagattttgtccaaagctagactttgatgggagcaggcaagaagtaacatttcctgtgtccctactatgtgtcagacatcttctgtaagtccccacactatcctggcaagaaaagcatgattatcccagttctatagaagagaaagtagggtcaaagaggctaaggaactagcctgggatcacagatttttaaccctagtctgtctccaggatcacccgcaggagtaactcagctcaggaagcagctgctgacgtgcccagcaactcctcaccccagctttctggcttggttactccattagtccccaccagcaccacttcctcccagctcttaaagattctattcccaagtccatttctttcacatctagaaacttaggcttctttccttccgttacttccagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtat

SEQ ID NO: 6744 - DNA, 2412 bp, Homo sapiens
gacggagtctgtctctgtcgcccaggatggagtacagtggcacaatctcagctcactgcaatctctgcctcccaggttcaagcaattctcctgccttagcctcccaagtagctgggattacaggtgcctgccaccacgcctggctaatttttgtatttttggtagagacggggtttcaccatgttgcccaggctggtcttgaactcctgacctcaagtgatccacccccacccccattggcttcccagagttctgggattacaggcgtgaatcaccgcgcccagcccaaatcgccgaagtctttatctcctaccttgatctctgtagcagaaaagaacagtatagatatcaattgtcatcaacagatgcaacatatcttgtaaatcaatatattttcaagtgaggtctctgaatcacctgcactgaaatcatctgtgatgcttatcaagcatgcagattctcaggacccttcactgacttcataaatcttcatctctggaggtgagaccctggacactgtatatgcaacgagcacaccaccaatcctggatgagccccgctttttctctgtgccagaaccttaatgccacgcagcattacattaagtcacattacaactttggtcaatggaaacacaggtctttttctgacaaaatgccatcaagccaggtttgctccccacttaagttcaaatattaatcattaattttctgagcctaaatgcatttatccatgttaaacataattattttaacctcagcttgatttggtctttttaacctttgttctgttaatgagattcttttttcagcctgtgttgaatcatccacaaatgagtattccacatcattaataaataatgctaaggaggacagaaccaaggacagaaaccggtaagacgactcctttttctcatcaaattagataatattcagcacagagttgttcaactgactacaagtcctcttaatgcttaaagcctctacccacacctcaatctcccattttaacgccaggatttcctaggcaacactgtcaaccccactgaaatcatagaagcctgtgtttctcaaaatgagagaagaaactaaatgttagtatccttttctagataaagttatagaaaagggccaaatcatgatttgtgacattgcccccacttgcttctaccagttttaaacactgtctttttggacctagattttaagaaatattggtggtttatatagcaccataataaactatgacaaaatatactttacaaaaatattaatatttccaggttaatccaagcatcgaacaaaactcttcgagatgaagtgttctatcaggtgaaaagccatttcctttccttatgctacctcattcccttttccaagagttgccttccctcccacacctagtttgccatttccaggggctaagttcaactgatggtccacaggtcctttcacaagtttgatttttacaaaagtaaccttcatttcttttactttgtctctttttgtctgcttcttggtggtgctctttgtttgaaaacattaacagttccttgtttgttttcacttgtgaacttggcacagggaacattcttgagttgcactgcactttggttgtcttagctgcttcctgtaatcctgatttaacagatcggtaggcaagcctattggcatactgatccattatcaactcactattaccaccttcctgttttagtatctgaataaggtgacctgcatattcatctgtcacactttcacagctgggatacttatacatcagacctgacatacaagaacttggtggtaatgaaagaataaacggatccacttctcttgggtgcactacagcctctatatccaacttctcttctactttataatcttcgtcaccatcagcataacaactgttcttcttttgcttgaaaagcatacaatttcggacttttgctattttctcagcttctgtaatgacttctgctgccagatcacccgcaaaattgcataatgttttcaaattttcgtctgaggggtttaaaaaagtaggcgacacacttctttgactttgcacatttaagcaagggtttttaaccttgggttcttgaattattttgttatctaaatgggaagctgccatttcagttgcaagagaaaggatgtgtgtagctaatgcttctgcaaactgaaccttcttccctgagtgctccgacttcacatccacttctgggagctctccactttcactactctcaacttcttcagaaagagatcgcatgagtttcaacatgaactcttctttttctatagtattttgttcattctcagacaaactaccaacagatgagttgtgtggagtagaaggtggtgtagcaggtgcaaactctttggctaattctcccttgagctttttagt

SEQ ID NO: 6745 - DNA, 2608 bp, Homo sapiens
ccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggatctccctaatactatgaacgcggcagagataacggacaagctcggcctccattccctccgctacagaaactggcacattcaggctacttgtgccactactggacatgggctttacgaaggcctgaactggctcgccaaccagttccagaaccagaactgatcagaaggatctattctttgtgccttgtggccacatcagctagcctctgctgtgtgcacgtgtacgtgtgtgctgggagtggaggcagctttctcacagtgccttatccatgccataagaaaagcagtgttacattttaagaaacccagtgttaagttttaaacaccaccttccatttcagtagctttgatgatcatttttgcaattgatggagaagtccagagggcttgctggtgctcgaaggccagagcgggcttcatggaggcgagttggagcggggactgagttcagctgttgcaatcctggtctggcgtctggagtcctgttagtctttggcatcctttcgtaaaaaggaaggaattgtcattcttttttttttaaaaccatatttttactgtaccttttcatgtttatttattttttattaaaaaaattttttttgaaacagcctcccactctgtcgcccaagctggagtgcagtggtgcgatctcagctcactgcaacctccgtctctcgggctcaagcaatcctcccacctcagccccctgagtagctgagactatgggtgtgcaccaccacacctggctaatttttgtattttttgtggagacagggtcttgccatgttgcccaggctggtctgtaactcctgagctcaagggatccacccacctcagccttccaaaatgctgggattacaggcatgagccactgcgctaccgagaaatcgtcattctttaccaccactgctgcagctagcagctcactcttcagtgctttaagcaaatgatcctcaggaaagaaaaggtatttgcttattgcaggtgcaaagaggctcagattggaacttttccctgaaactatattgtagcccagagttcctgatgtaagacgctttatttaaagacatccgtgagctttttcactggcatatcaatacttcataacactaggaaggtatccagccttttccttatgctagttccttcccttatttgccagatggggaccctgtggggaggtgacccagtgtgaggccgaagctctttcccagagccccacaggccagtggagggtcgtgtttgtgctctgggcatcaccgtcttgggtctcggtcccctgcgactgcagctgctacatccctccctgctctgagataaatgttcttcccatgaagcagacggttcacttttgggatggcgctgtctccaggtttggctgtctcagtccagatgatgtttggttagtttccattcccagaaccacaagcctttgagttctgaaagtttgtgacagaatcaagaggctaatttgggagatgtgagattcccagcccacctggtattgccctcgagttagtggtaaattttgctatggaaaatatctcttgtcaagaccaagctccggcgcattgcctccctcttttggatggccatggcatctcatgaaccacttggaaatgtgttttatgttgttctccaaatattaataaaaatatcccggagaggaggttcactaa

SEQ ID NO: 6746 - DNA, 6696 bp, Homo sapiens
actgcagtgtgggagtagattggtacttactgagcacttagaaacatcacgcatcaggaaccgggtcagggtgacagcatcctacggtcatatcatgaaggaagcctcccttacaaacctaaaaaaaaaaaaccccagcttcagtttgctaccaattaagctaaagcagaacggtctgcttcctcctccgcctgcccccttctgcctcttttctgttggggagatgccaattctaaggatttctcagaaaataatgtaatctctcattcaatgtcaggacattccagcttaattgtactgaaagtgctccaataggcatgctctcgttacattggaatcaaagcagaaaagagtaatagcagcgtgggggagtcatttttcttcttgaggaacaatacatgctgttctgtatttttccattcatcgcccaaacctgcctgtgtctttgaaatgcaagtaagatcccaaaggcagctttctgaaagcccgtggcatttttagcttatcccatcccccgtgtgtgtcctcatcttcagaattgaaagttaggatactttttaaagtttcaaaagaaaataatttaaaatgttaaggtttatccatagaaacacaataattcttaaccaattcatgtaccaaattcaacagtattatctcatttttagggtcacaaatgtgtcctttttgcacttaaacctcctccctctctcaaaaacaaaaacaaacaaacaaacaaaaaacacaccaagactgtttaacaaattgtatctcaactcttaatatatgttaagtcttaccacaggacatttgaatcatcaaggaacagttgaagtttatggatggtagaataacaatgaactatgatattatcactttattataaactttttggaaaattggcagttgctaccatcgaaatactccattgcctgtgttacatagaatttgttataatttttaagggctttaaaaaaatacccatctgtttcttctccttcttgttttcttttgtgccccaccacttaaattacttgggtaaataccactcttcaaaatttgaatactgtctatcaaataagaagaagtgtgaaagatatgaagaagaaaggtgatagcaaattagaagaaaataaatgtgggtgatttcttttagttgaaagcacagagttttatttttccccagtataactattgagtagggtagggaggtccctgtatccccatttttattttttttgagatggggtctcactctgtcacccaggctggagtgcaatggcgcaatctcgtctcaccacaacctccgcctcctgggttcaagtgattctcttgccttggccccctgagtagctgggattacaggcacgcgccaccacacccagctaatttttgtattttttttttttagtagagatggggtttcaccatgttggtcaggctggtctcgaactcctgaccccatgatctgcccgcctcggcctcccacagtgctgggattacaggcgtgagccaccgtgcccggcccatctccccatgttttagcatagacagcagcggcattcagtggaaggagttcttccccttcaacatcgtccttcccaaaggccacattctgattctattgttcaccaaaaactaattcccagggaagcccgctctggatgggaaggatgagctgcgtgagccatcgcccacacagggagataaccgaacccctttgccagcatcaccccctctctactggggtgagacacttcattcagagcactggctctgactcccaggggaaagtctttttccctttacaactcctcacctcagcctcaccttgactttcacttctcaactgctgaattctataaaatagccttttagcagtgactcagcttttaggtgagcacagataatgaagaaattgaagtgccaccattgcactcccccaagttggggacataaactcgaatttgcacccaggtctgataaaagtaactgattgaggacgcagaaaggtggatgccattgacagcgttgactgttctcacaattcctacagaaatgaaagaaggagaggcccagcagaccacaccgggccatgaggggaagcatgggagacaggcagaagcaggagtgaggaggaacgtggctcagaccctctactgtatgttctgcaggaaagggcagggaaatagctaagactggctggtctgaataacagctcagactctaggctatacaggtggtctctagccatctggcacctagccccgggtcgttagggtgggggatattgcttcctaggttgtaagagccagatagaggaggatgggctctggattggtcactttgctcccagggtagccctttgctgtatctaagaattggctcaccctgggatgggcagtttctcctgggtcagcgaggcccctgagatgtcaaaatatcataaaatatagaaatcatgattaatacaattggtcctctgctgttttgacatactaaggtcacttttgatagcagaaacttttaaagagtagggcatacgttgccctgaagagcatagaaaacattttattctgagagtagaaaggaggaagacacgtggagatacaggagtcccttaggctggcccatagctgagtctctcatgtgtgtggcattagtcaagaatgtagttctgcagtttgcggggggggggtctctaacatttcttggtgcagttgttaacatgtgttaaacatatgagtctgatgatgatatcgcggtgtttctcggctcggggtggcaggtctggcggttgtgtggctgggggtgtgcactgatagttcagtaaaggataagtagagactcgtggtgttcatgtgtcaccacagggagggagtggctgtggagacccaggacaggaagtcgcggtggaaagcaggctggggtggtaggagaaggcaccgggggtgggtgctcctcccccaggggttgaggagttgactgatagggggcagttacctcctgggaaagcaagacgctcccttaagttttagaatggtacagagagtagtcccttctaccagagtttccatttagacatgggagtgtagggggccatgtttcggcagaagcagggcatgtatcagcattagtggactcctcagtattaaaaggaagaacagcaaacatgtcatgtgcccactttgtgcctcaggagaggtagcccgtggacatcgctagggcagaggttttaatatctgggacaaagttatctcccacggcgaggtcgtggctgggaccatgtcatcttcagccgtgagctgctgggctgggcaatgtcttctgggatgtgagacgtggggtctcctttctaagcggacccccactcgtgctgatgtgggtcccagcatttgccgcgtttggttgaaacagtggcttacctggagggtctgggtctctggatcataaaccagcgaaagcccccacatcagtggtgacaagatcaatagaccccagaatgtgtgcagctgtgcttgatagggttttggttcttgctttttggtggaagtttaggctcaagtgggtcccgtatcggatgagcagctgcacggcctgtgggagccctggggttagtgggtccaggagagaatgtgttctctctctgggctccagccctgatggggtggggataagatgcaagatttataggaatagggggaaacattatggaaggccccaatatgtaatgagcttttatatacaagaatgcaagacatagccctctttttatgtttaaaggggactatggtaatgttttttaaagtttgtgtgaggtgtgagtcaaccgaaaggccctaaattaagagagattcaggtttgtggtgcaagatagaggcccatttcggggtctgtttgcagaccagaatttgaaatggagttgtttgaggagaccattgtgtgtcttcgtgaaaccgattgtgtggaacctatcagggctgtggaagttgtagcgaatgccttttcccagagcccagcattgtggattccgagaagtggcatgtgtgtctcagtgacttccagtgatgcctgccactctgaagagatgaaggagtgtcctggcaagacctggaatcccagctgtagcacctgtggagagatgtgatttagatttggatttggggtatctgtgaggaagagtcccagagtttttcatcctgaagggggcaactcttgggcagtggtccaacagttggccataaatgtgaagctggggcgctgtgctgaccagggcatccagcgttaagacgactgcctaactttggccacatgcgttgttttttgggttccgtttcgtatcagggcatgctggctaaaagatgggaagcagcaacattctcttgggctccatcatttatatgagggttggcaatgccatctgtaccctctgtgaactcccactgctgttcactcagttaatctaagggacaccaaggggtctgcgggaggatgacctcacaagggactgaggacatgggagaccaccctcctgtgggtagaatacaccagagggcccaggcttgactctgtcctgtgttaaggaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagcagcagcaagaagattaagtaaaatttgtaaatgaggactacattgccatcagaacctcgaaagtatctaaagatgttggacttgtatgtccttaatgagtgtgacaatgagtttcctcatttgtgctcctggagaaggcggatgtggtgaagaccctgtctgcagacattgtgtgccatggcaaagccgtggagctccctgtgggtggcctgcaaaggtgtatgtgcccctcagggcagaaggcaaacggcagccaagaagctgtgcaagtagacacttaatgggacatgttagccaaatctgtaagagcaaaatattggccagttatttattgtgtagaattaataattttaataataatggaaattgggtaatggatgggactgcagcaataaggttgtagtaatccaccatgaggcacacttgtttttttccaggtttaaggataggaaagattgggctgttcaatggagaaacaagggtataatcacccctttattaattagtaagttttaatccttgaatacctcatattaactgttttaactggaggtccatggggcatcattttatcaagctagtttataactgccaaagactgactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattctagcatttcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaa

SEQ ID NO: 6747 - DNA, 796 bp, Homo sapiens
agattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggtgtgtgctgggcagggttgggggctgggggccagggcatgccaggctctgattgccaccccctttttaggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggttagatgggacagtcctacccaagcactggcatgagacaccgaggtccacggtggagggagagcaggaagcccagcccttcctggataccagccctcccaactccctttcttcctcactggcaggaaatcaagaaagctcaaaggaccggcgcctgaggcttgctgtctgttctcggcaccccgggcccatacaggaccagggcagcagcattgagccacccccttggcaggc

SEQ ID NO: 6748 - DNA, 977 bp, Homo sapiens
atataagataaatatagtggatcatgtagatatgatattaaagtactatattttataaggaaggtggattattgtatatttaccactgttttctgcttaagaaccaaggtgatacttatataattgtttttaccctagcattttgggataattcttgagtcataaaaatctcctgatcaacttggtgattgaattggattgcattagttctgatagaaactgtttaaaaaattacctgacattctatagaaatgaaaggagccatgctgtgtaatcacaaggctttcatgacatgacatttatagattatatgaaataggtaatttcaaatgtaaattttaagttttatttactattagtcatcgttttttgattatttaaaaatttgtactatggacaactaattaattttactttttatcctctgagatttgattgtggagcggcataagggggagaaagataagttgaggacgtctctttatcttttgttaatcagaggtggtgatagagtggaaaatataacacgtttcggcattcaggagacctaccttccaataaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaa

SEQ ID NO: 6749 - DNA, 5124 bp, Homo sapiens
ctcccagtgcacagggctggggccactgccgggccttcagttccacactggcatgtgtgctgtgcccttgggtgcctttggctcctgttggtcaggcgataactgtccccgtgggcctctggtggcccaaggacagcatcaggaaaaccaaaggactgcagctgcagggagataggccctgagccccactgccttcccttgtccatgtaactgtgtccttgtcaaaaatacaatgaccagcctctgcttggtgaccatttggttgtgtaatagtgttcagagactactctgtcccttgttcattttgtcccatttaagtctctgggctcagacacagccctgccagtactttctgaagcaaagccacggtccagggaggaagctgctttctataggcccgaggctcagcccagaagcccccaggtcccctccgacgggaactggacccctcacctctgcgggtaatccagcaaccccacacctctggaactgagtatctgccctggagagctgagtgagggacactgctgtcccatgaggctttcccttacttcagtcaaaggaatggtctttagacatgtatttttccggaaaatttcctgggttctcatgtcagttgcttcctagagtctcctgagactttttgtgtgtgtgtgtgtatgtggttgttggctttttctgtgaccctcaggagatagggcaggtgtggagtgaaatacgtaatttcactggaaaggagtcatgagtcaaaactcacttggagggttactaagccagaaagcatcagagttgctgaattaagccagagccaagggacttgcctcaacatcccatcatcagtgagaagtggccatgtcaccagtataagctgtcacctcactcttgcaaccatccgctctttctgttcatcctcccgtgtggctccgctgcactgctggttgaaatcactgcattttatgtgcgcatcacactcccacctcctgtccttctgacgcatgctcaaaagcaacctcttctgggtccaaggcctctgtggtcctgtcagaggccttggtgctgaagagtgtcctgagcatctgcgctgatccaaggattcttggattgggcctcttctggtttgggtgggttggagagaatgacgagatgtagttaacagttacatcccgaccctgttgtggttgagtgtgtgtgcatgggtgtgtgtgttctctttctaagcagagcttgggtgagggcaggcagtggtggtgactctctctctgtccagttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcaggtaaacctctagtgttatctagtatttcacaccaagtatagaagctctgggtttagccgaggttctgaacttcagctgggtcaggatcctcttttgaaaatctgatggtgaccttcatcccggaagagtattacatttgatcaaatatgggaataaaacttcaggtacagtatcaaagccctgaaacttatccacagaacattactaagtcatcttcagaggaaacccaaaagatttgggtcagagcaaaatgatgatgtcttttcccagcaagcctgccaggactgtcaggctttgttttctcttatgcaaggcctggccttgcccaactcttagcacccggcctgtgggcagggaggctgccccctgttcttgtgtgctgttcaccttgctcagtttgttcagttcaacaaacattcctggaaacccttctgtgtgccaggtaccacctgccctgggagtccaaagatgaatctggcctctccctcccctgggtagcttctagtgtagtctgggagttcattaagccagagcttactctctcagcttttctttctgcatttggccaccaaaggtaatagcagtatagctgaggccctaggatgagctatttccatcaaacttttatcagatatttgaagcacagttgtctgtcggggttttatggattagcaaactatttacttttaatgaaattcaccttttgaagaagacctacattctttttgcagtggtatattttgagttactgccttaaaaaaatcctcttatttaaaaactagagattaaacataactgataaccaatttctgaaaaagcttaatgtcatcaccaaatagaaaagtactttgaacctactgaggggaaagaacatcatgccttttatttttccctttttctttcttttttttttttttttttttaagacagagtcttgctgtgtcgcccaggctggagtgcaatggcgccatctcggctcactgcaaactccgtcccccaggttcacaccattctcatgcctcagcctcccgagtagctgggactacaggcacccgccaccacacccagctaattttttgtatttttagtagagatgggggtttcactgtattagccaggatggtctcgatctcctaacctcgtgatctgcccacctcggcctcccaaagtgctgggattacaggtgtgagctaccatgcctggcctaattttttggtatttttagttgagacagggtttcaccatgttggccaggctggtcttgaactctggacctcagatgatctgcctgccttggcctcccaaagtactgggattacaggcgtgaaccatcgcacctggccattagcttacattttatcgctaggatttattaataaaaggataattcacatggaatatgtgttctagacatagtaactgggaactactgtgaacagcttaagccaattctcttaaattgttggatatatatcagtgcatatgggcaaccttattatatgtatacaaaatcaaaggccacttctgcctccgagctgatatattagaggattctcgtatccatgcgctggtatgattcctcaactctttctaaagtatgtatggtgggagaattagtttggaatgcatagcaagtttttatatgtacttttaaaaatcagtctaagccctaaaattatcagaacaaaggagggtgacagcctggcaaggcattcttccacatagctgttctttaatatcttcctacagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaa

SEQ ID NO: 6750 - DNA, 5145 bp, Homo sapiens
gggcatttgaggtaagaaatttgttagaattgttaaaactaagaatttctattttttatgcatgtatgtgtgattaatttgggtaagctagtcactgaatttggacgcaactgaatccagtcctgctgctctgaaagtgaaatcagggctactatgagagcatgtaacatttatactaatacttgaaagaagttgaaagatgagtcattgtgagttcagtacgggaaaggaaaagaggctctgacaaggagctttgcatgtatgaacagccaaacgcagccactttggctgggccataatgagggtatttaagagagattccagatcaggctggtagatcctacaaggtattgatcaagttaaatattttggtttcttactgtattttgtttctgtcactggcagttcctggttgctagtgagagaagccaacacacacagccaaaaaaccccccaaaacagtattataggttactagagtgattcagtaactgtccccagtattagctagaattaggggatgaaatatttagagctctttttgtctcctagttttgcctttctctacattttggcttcagttttctcccacccatgtttctcattctgtacaccagctttctcagcctctctggtctgcatgacagaaaacatggctcttgcatgtaacatactgttgcatgtaacagtttataaacaatttacagtttaaaaacctaaacaaactggtaaactcactttctgttccaagcccaaaaatcctagagaagggatgccctggcctagcttgggctagttgtttatctccagaccagtcattatactgtgattggtcctgcttgtgtccagcaaacgggctatagagcagttctctgacttacaagatcatctgttgagatactgaatactagaaaataaatgagatgttaagtttgagataccaaacatctaagtgaagatgtcagataggtgaatggaatggagggctgggctagaggaaaaaaattataatcataatggttataagtataaccattatgtcaatggtagttgaaaccatggatttgaagttgaaactgtgagattacctaaggaacagctatatattgaatctatgaagagagaagtggaaattgaaaccacaagaagttagaagtaaggcctagaatagagccctgagaatatatatggtccccagtttatgatggtttaactttttttgactttatgacagtatgaaagtgataatgcattcagtagaattcatatttgcagaacccacgcaaccattccttttttcattttcaatacaatattcaataaattacatgagctattcagcattttattataaatgaggctttgtgttagatgatttcgcccactgtaggctgatataagtattctgagcacatttaaggtaggctatgctatgctatgatgtttggtaggttaggtgtattaagtgcattttccatgtaaccatattttcttacagtgagtttattgggatataacatcatcgtgagtcgtggagcatctatactaatattcaaaggtgaatttgtggaggggactgataaagaatgaccaaaatggtataagagagtagtgttggtatccaaggacagaaagcattttgaagaagagagctgggtcaataactgctaaggactagatgtggtggttcatgcttgttatcccaacactttgggaggccaagacactgcctctacaaaaaatttaaaaaatgaaagtttcaaaacagtatatccattagttaacattctttagtgtccaactatcaattgttagtgtacatacacctctcattatacattaagcatgattcttatttattgaaatattcaatacatataagaactatatcttatatgctaaatttctgaaaaattattttagatatttttaaatttgtacattccagttacttttttcttgtttgtttaaagagaaaacagaacagggctacatagcagacttactttgcgataactttgacatagtaaatcttctgatacttagtcttatatttttcctctttaaacatatcttaaatttatccttactgaatttcactttatgctgacttgggtacctgaaggtatgaagataggaagaagaagataaaaaatgaaaaagctccctaagtactatttctaattgtagtttcttctgacgttttatggaagaatgctttagtaaagtggtttttcagtgaaaagtttgttcagcttttaagtgtttacaattttttctggtaactgcttcaatatatattacattttaaagtccccttcccctttgtctcatatgtagaggaaagtagaaaattgcatattggttatgttttacctataaatttccaccatgatttttcatacgtgatagtatgtagtttactaaatgcttacataccaatgttgcaacttgattttttttttttaaccttgtactttattatacatactaacatcaccagtgaaggacagatagctgtcaagtacctctagatagggcacatcacctgtgtagtattctggttgagaatgcataacctaatccactcattaaatatcaaacaaaccccaaatgagcaatattttattaataaaaagcagatttagggaatttgtactttaaaacgttaatgtcataaaaaacaaaagaaaggctaacaagacatgacaactgaatgcaatacttgtccctacttgcccattactgggctcctgttctggaggagggatatgccacaaaggatgctattggattaattcacagaatttggaatacagctaataaagtattgtttcaatgttaaacttactgacgttattaactgctgtggttatgtaagagaatgtgcctactaggaaatacatgttgaagtatttaagagtaaagggccagcacatatgtaacttctaaagtagtttagcggaggtggggaaatatatatatgcacgcgtgtgagtgtacgtatatgtatatatatatagagagagagagaatgagatttagaaaatgtaaacaaagttacatctaggtttacatattttataatctatatttatttaccttttatctttcaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaatttc

SEQ ID NO: 6751 - DNA, 733 bp, Homo sapiens
cagtaacacgtggaggaacatacgttgggaatatcaactgacacgcactgtgctaggatctagaaataccatgtggactccaacacacatagaaataaggaagtggaattccaaaggaaggcaaagtgtaaagtcatctttatggaaatgagtgatgaaggtgaatacctgaatgagatgtcaagaggaggaacacactggagagaagcagtaaagatttaggactgaaccttaaagacatacaggcttgagagaaagaaagcatgtaaagaagacagaaatggttagaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaa

SEQ ID NO: 6752 - DNA, 3825 bp, Homo sapiens
ttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaagcggatcctgttacagtgcaaagaagaaatggcaaacggataacagctactgtgcctagaagatggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaaggtaaaagcaacagcagcctgaaaatgcaaaagaccatacattttaatggtaagtcctccccaggaaggattaataaatctcaggaggaagatttattatctgtaaatccaggaggaagaaatcaagatgaaaactatcatatttataaatttgattgttgcaattttatagtttgacatagtgcaattgctttagatttgaaggggaacttactttagagtaagtcactcaatctcttttttggaaaggcaaatgccacacctgatcctcatcactcccttctcctttgtccatagcctggctttattctgccattaacacacacacacacacacacacacacacacacacaaattgggaagaggatttctcattttacagaaagtatgctgggctacacaggatattctatcaggtttcttccagctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcctatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcaccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatatcttatatttaaggaatagttttaatagcttacatctgtatttctattagcttccgtttctatttttaatatttgtataatattaaaagtaattttaaaaatgaactaatctttttacatctcttatgagaatttaatggagatatgatgtttgaagatcaaagatacgtggtatttgaaa

SEQ ID NO: 6753 - DNA, 661 bp, Homo sapiens
aaacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgtgtaagtaaactttatgaaatagactaggattgaatgaaactcaaaaccatttgagatgacaggctgttatttcgttaatatagagatgcatctcttgactttttagtgctgttggagtctactgatatttacgagtacctgataattgagggcttttagatcttacatgatctgtccagaaattctgtgtgctaggcactattttctttaataaataaaattttacagagtcaagaaagtattaaagacactcatatgtcacaaagccagcattgaaacctaagtcctctttgtgctgttaccttgttaatttctaatgtgcagagcaaatgcttcccatccaaaaatcactgctgtgatagaattctaactct

SEQ ID NO: 6754 - DNA, 787 bp, Homo sapiens
gtcattttctctacatcaaaaataagacatcaccagtcctaaaggaatattataattcataaacaaaacattatattaaaattttatactaaagtataaaattatttctctctaggcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttctaataacgtcatgtaattggaccaaggaagagttgctaaatgaattcagtgaaggttggagtacagtggcaggattttggctcactgcagccttgacttcctgggctcaagcgatcttttccacttcagcctcccgagtaggtggaactacaggcacacatcatcatgcctggataatttttgtatttttagcagagacgaggttttgccatgttgtccaggctggtctggaactcctgggctcaagtgattctcccacctggcctcccaaagtgctgggattataccatgccaggccctcgttggcattttagatttgaacttctcgaagagctaccaacacccaagttcagctttggaggcagatctggaaacagtgtagcagcattggttttccaaaa

SEQ ID NO: 6755 - DNA, 939 bp, Homo sapiens
cttcccaacatggcgcagtctattaacatcacggagctgaatctgccgcagctagaaatgctcaagaaccagctggaccaggtggggacgggccccagaggcacctctttcctgctctacatcccccttgcccacgcgtacttctcgcgcccggttccaagttggcagcctacctttcccaggcgaaacctctatccgatcccaggacctgccccctccccggccgcgctcctttctccccttagtcctctcattgacccgctatcccggtcctctgtaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaag

SEQ ID NO: 6756 - DNA, 579 bp, Homo sapiens
gcggtggggctccgcgggcagcctggttgcgctgcacccggacggggccgaggggacctgaaagctgcggcagagcctgaccgcgccgttctccagaagagccccggccgcggctgagtcgcgctccgggtgtggacggagccggagcctccccggggctcggtgaggacacagggcccaagccccggaccttcaagtcttgaccgagcgcatccccggcccttctgcgcccacacctgagtttttgtctgtaggagtttccgcagtttgctaagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataacccttta

SEQ ID NO: 6757 - DNA, 2493 bp, Homo sapiens
cgcaagcgcaggccgagacgccgcaggtcgagtaccgggtggcaaagcagctggcccgggccgtggaaggtggccaggccaccgcggcctgtgacgcgcacctcggcgcccaaggcccgtagccgcgcagtttcctcgggcgtcaggccgccgcgcagcccggccgtatacacgggccccgcgggctcgcagagcaggagcgcgcccgcctcagtccccgacggggcctcaatgcctggctcggcctgcagccgccgcagccagcggtcctgcagccccagtagctcggcgtacggcacccgacccaggcgcaccaaccgaacggcgggttgccgcatcgtgcccaccgttgcgtccgcggggccccgccctctccgtgggcctgggggcgtggcctgaggggcggggactcgggggcacaccccgagccgcagctcccaggtgcgtgttaaaagctggaggggggatatgtgatcccaggaccaaaagcgcggggccagactcatcggttcattcaacaaccagtatttagtgcctgctgtgttctgcaggccctgccataggcgcttgatacagcggtgcatagcgtatgagaaagatctgtcctggctgagcatccgtaatataaaaatctgaaatctgaaatgctccaaaatcctaaactttttgagtgctgacattatgccacaaatggaaaatttcatacctgaccttatgtgagttgcagtcaaaacacaggtgcacaacacccagttcatgcaacatccccagtgggaaaaaagacccccccagctctcttctgctgcagtttttctgctcacacctggatttccccatgcattcccacaaaaagtaattaaatggcatgcgtgcaggctggacacgccaacaacaggtttcccacaatgccccacatggggccaagacctgtgtgcattactcactgcatttttttgcttattctctgctgtgtggtataaatatattgttgaaaatgtcaaaaagacctaaagatacccctgtgaatatcagtgataagaaaaagaggaagcatttatgtttatctatagcacagaaagtcaagttgttggagaaactggacagtggtgtaagtgtgaaacatcttacggaagagtatggtgttggaatgaccaccatatatgacctgaagaaacagaaggataaactgttgaagttttatgctgaaagtgatgagcagatattaatgaaaaatagaaaaacacttcataaagctaaaaatgaagatcttgatcgtgtattgaaagagtggatccgtcagcgtcgcagtgaacacatgccacttaatggtatgctgatcatgaaacaagcaaagatatatcacaatgaactaaaaattgaggggaactgtgaatattcaacaggctggttgcagaaatttaagaaaagacatggcattaaatttttaaagacttgtggcaataaagcatctgctggtcatgaagcaacagagaagtttactggcaagttcagtaatgatgatgaacaagatggtaactttgaaggattcagtatgtcaagtgagaaaaaaataatgtctgacctccttacatatacaaaaaatatacatccagagactgtcagtaagctggaagaagaggatatcaaagatgtttttaacagtaataatgaggctccagttgttcattcattgtccaatggtgaagtaacaaaaatggttctgaatcaagatgatcatgatgataatgataatgaagatgatgttaacactgcagaaaaagtgcctatagacgacatggtaaaaatgtgtgatgggcttattaaaggactagagcagcatgcattcataacagagcaagaaatcatgtcagtttataaaatcaaagagagacttctaagacaaaaagcatcattaatgaggcagatgactctgaaagaaacatttaaaaaagccatccagaggaatgcttcttcctctctacaggacccacttcttggtccctcaactgcttctgatgcttcttctcacctaaaaataaaataaaatacagtgtacagtaaccttttagtcaaaacagcatcatacttggaaactgaaagcctactgttatttgttattgttgcttaacagctgatacaggtattctggtgacactactgtgctggcttacttaacctgaatacactatttttttcgttgtattactggtatgtcattttttttactgttaagtacttatgtgtgaataagtgtaaaaaaatgattgcttatcggtaacatataaattcagaatcaggaatgatggtgatgccaaacaatcacagatcgtccacatgggtggcggagatgttaacacctttgctttctgatggttcagtgtatccacactttgtttcatgccaaaattatttaaaatattgtatgaaattaccttcaggctatgtgtataaagtatatatgaaacataaatgaactttatgtttaaactggga

SEQ ID NO: 6758 - DNA, 395 bp, Homo sapiens
agttttaatttctgcagtggtttaagtgtattccttcaagaaataagaggaattatattacctgttttactctctgtttccccaatgctttttccatttactgggtccttattctgttatttaaacaaacaaaagcaaaatgctgtttttctcttcaggccctgacaagccaattgacagatgaagagctagcccaagggagactttacccaccgcttgctaatattcaggaagtttctattaacattgctattaaagttacagaatacctatatgctaataaaatggctttccgatacccagaacctgaagacaaggccaaatatgttaaagaaagaacatggcggagtgaatatgattccctgctgccagatgtgtatgaatggccagaatct

SEQ ID NO: 6759 - DNA, 531 bp, Homo sapiens
aacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtagcttttctctaacttaataaaaatatttgaaaattt

SEQ ID NO: 6760 - DNA, 2139 bp, Homo sapiens
cgcgcatcattcctggaacatcaagagtgtgaagactgaagataacctgaggcctaccagacatcctatattcaccaagattcacattttttggtatgtgtgcctacattttagcaaaaattggttggttaatccttctaaaattagagggatgacattgggtaacaaagtcttcccagcctttggcattatagtaatttctcgcaatagaaattccatacagatattattgccagtgaagagagctattcttgtttattatcagttctatatttttagctgaagcaacttagccctaaaaaaccccaaaatcaacttcttcctccaaattaaactctcccccaaatttaatggtttctgttttcttaaatgtttttctacttgacactgttatgtcagtctcatgtaactgaataattgttcataatttctgaagagcatttagtctttgccatctggcttcagtgccaaatgattttcaattcttgtttttggagactaatgactttttccttaatttattatcaaatttgccacattttagagctcacttttagaagttctgctatggttaatgaaaacaagctagaatgacacagtagaaattggttaatacgtcacattttacatcactattttgtagaagatttttagtaagtttctctatttttattccttgccactctggattttacaaatattctgacctagttgatccatcacatggtctcatatcacaactgttgcatcgctatattcacatagatgtttttctgtttaatttagaagacagtatttctgaaaaagtatgaaacgaccccaaatccaaaagttatggtgcacaatgaaaatgtatgcttttaataatgctggcttctgcagtaggtgtagaccatgtttcaaataaccacagactaatcagaaactccacctgtgaaaggaacttgaaattgtgctattcctccaagcttataacaccagcaaattgggtcaataggttattcctttaaaataggactatgagcctacagaggctcactctgaagaactcagccgtggagttagttctgtactatatccatcacaacagacatgcttcatcccatagacttcttgacatagcttgaaatgagtgaacccatccttgatttatatacatatatgttctcagtattttgggagcctttccacttttttaaaccttgttcattatgaacactgaaaataggaatttgtgaagagttaaaaagttatagcttgtttacgtagtaagtttttgaagtctacattcaatccagacacttagttgagtgttaaactgtgatttttaaaaaatatcatttgagaatattctttcagaggtattttcatttttactttttgattaattgtgttttatatattagggtagtacatttcctaccctacctgaagacttgagattatagtctttggggggatgggcaaagtactctctttttttgcatcttttaaattgtgatttttaaaaacacatataaattttactatcttaaccatttttatgtgtatagttcaatgagattaagtccagtcacattggtgtgaaacagatcttcagaattttttcatcttgcaaatctgggactctatacccattaaacaactcccattttccccttccccacagccttggcaaccatcattctacttttctctatgaatttcactactttagatacctcatataaatggaatcatacaggatttgtccttttgtagctgacatatttcacttaacataatgtcctcaaggttcatccatattgtagaatgtgataggatttcctgccattttaaggctgaataatattccactgcatgtatttaccacatttttttatccattcatctgttggtggacgtttgggttgcctccatctcttggctattgtgaataatgctgctgtaaacatgagtgtgcaaatatctataattttttaacacagtactttattttcggtatttaatcatatggaatttttgtcaattatgttaaaggattttacaacaacccaactatagatttatatatatatgtattattgttgttccttctaagcttaagaagtctctaataaaatccatacttccttatat

SEQ ID NO: 6761 - DNA, 1819 bp, Homo sapiens
ttctgttttatggtggatacctaaggtttatataatagttgctggaaaacttaaagtagctggtgagcttcctgttatgtcactattaaagaatgatggctgatgtaactctgcccctgaaatctacaagggtcatgcccaaattaatacaggttaacctttgtagaggtatatatgttggcattatttattgacatttatgcttcaagcatgtcttattttatgtaattttaagaaatactctatttaacttgtgaaatatacctaaaagcatactagttagctcttagactctcacttagggagggtaaagaaacatcactgatgccaatatgaagatctataaacaaatcctttgtttagaacttttttctcttcgtgcacctcacaacacacttaccatggtacatatttcttaatgccactaagaaaggcaagatagtgaacgcagaattatttatgtggtatagtgtttgttttcctgttttagtgcttttgtagctaaaacttactggaactgcatcacaactacatttgcagtctcagtgggaggtggactagcctgtggttaattttagagcttaaaagtttataagcattaaaaacacatacatgtattagaatcttgtctaacccctcacaaaggatgatggtgatcagcatgccatcttttgaagattaattctaaaattgaggactctggtaggttgttttatttccttcccaaccagccattcatttccaattgttctgcctttgaaactttttgtgaaaattgcctgtaccaattgcattggttgcgttgctctgatttaaatgccaaaaacactaaatatttgtgtagtgctgttaaatgaggtttttgatatttccatcaaaatgaatataaaattcacttgatggattttgtagtgatgttttcacagttgaaacaaacatattgctgtgcggtggacagccacttcacagacatgcagacccatttctttagagatattaggtttaaaacccattttaattttattttgctgaaggtttggaatatataaagtaatggattcacaaaatatgatatcttaaaacatgttgaaagatttgaaagtggtgcatttttacttttaagagcagcaatctttgaaattagtcaacaatgcagtcttttttaaaagtcagttttctcaagtagtatgttgtaacgtaagatgtaactgatataactagattttgactggtaaacttaaagtgctttttatatttgaggttgactttaaaaagccattgagcagtcctcagaggttatggactctcaagcgactaatggaatagtgttctgttgtgaagtctagaactaaagcaccttgtattgtctgcttctaaagtgtcctatagtttttaacttaaagtgtaaagagtaacattttatcttatgtcaattaaagttacatttttcatttgttggtgtacatgtgctacctgttttatggggaatgtttaacacgatcctccaagttggttctatgcataaccattcaccaaatactgctgctgtgattccttgaaggaaatattctgtggtctgctatgatgcattgccatcttgctgcttgacaataggtttataaataattagaattacgtgttttaatagtacctttgtatatataacaagatgtaaaattaaagatgaggaatgtgtgtaaatgatcattcactgtttttgttttaaaactggtcagtactatgaagcttctgtggtttgtatgatgttttaactttcactttaaactgcatagaataaattaaattgaaaacaacaaaa

SEQ ID NO: 6762 - DNA, 3305 bp, Homo sapiens
tcagtgagatcaaacaaaacatacccaatcagtgaagaagccaggccagtcccaaaaagccattggggggccagaagaccctcatccatataccaccagataaccagaaaaacaaaaacactgcacagctgcgggatcaccacactggactcaaataccatagcccaatattggtatttccgagcatggatgtttttccagagctcttccaggaaccgccggtccacaaagttatcaggaaagggctgttgctcatacaagaccctctgccactttacctccttggtgtttgttacaggttgggtacacataatcctttcattcaaactcaggctagtttaatcatccctctcacagaggtccatgtggttcttgttgatgacattttgaaatgagacctccctggaaattccatgccttggttgatattctgctgacctttccttgttttcaaaggcagcaatccaggccaggcctacaatagatgagtttgtctctgaggcaggatataatacagccaagttcctggggatgcgtgactgggagatggcagttgcctgcctttttccttgtaagggttttttttttttttgagatggagtcttgctctgtcgcccaggctggagtgcagtggcgcgatctcggctcactgcaacctctgcctcccaggttcacgccattctcctgcctcagcctcccaagtagctgggactacaggcgcctgccaccatgcctggctaatttttttgtatttttagtagagacggggtttcaccgtgttagccaggatggtctcgatctcctgacctcgtgatccacccgccttggcctcccaaagtgctgggattgtaggcgtgagccactgcgccctgccatgagggtacttttaaagaagataacatcttccatggtgtattcaatgaggtcgtgtctggaattgttcccttaaggtggaggctgctctgtggccactgtgcctggcggttgtatgatcctgggttcctgggcagagaagcctcagcctcagagtgtttggggccttttcctgccgctccaaggctgaaggagaggagcttaaccccaactgcacagcgctgatcaccacttcctgcagtcattcttcctaaatctcaaaaactcttcttttgtaagagtagattcttgcaagatatttttcccctcctgagttcttacattgccagagttccatttggaccgtttgaaatcttgatgcatgaataactggcttcacagactcttggccgcccactacctcggtgtccactggtggagttctgcaactggcaaaagtcaagaatgaaggaagcaaacttcagaaccacaatattcatattgaatcattttgttgttgctctatgaagataagctaattttcttcctggaatctcataggattattactaagggccagggagatccacttcgttcatttagtcactcaggaagcattgctaagcatccccctgtaccttcccctacagctctccttccaaaacgaaacatcctttggagtgtgttgtcctccagaatcgaatggattctatatgctgcattcagtaacaggttgtggagacaagtgtcttttcctgaaattgctaagtgtatttggcagtactttactacttgtggatagaactgagagtgaggtcagtatcaccaagcctcttggatttcttcagtagtctcatggataagtgaatgtttaaagtaactactactttgttggctcttggttgggtggatggattctcagtcctggtgtttttaaaaatctcattccagccgggcgcggtggctcacgcctgtaatcctagcactttgggaggctgaggcgggcagatcacctgaggtcaggaattcgaaaccagccttaccaacatggcaaaacccatctctattaaaaatacaaaaattagccgggtgtggtggcacgtgcctgtaatcccagctactcgggaggctgaggcaggagaatcacttgaaccctggaggtggtggttgcaatgagccgagattgcgccattgcactctagcctgggtgacagagcgagactccgtctcaaaaaaaaaaaaaatcgcattccgtctaaagcaagctacaaaatgtgattatttatgtcacgatatgacccagccataaatgtacttcaggtaagaaggacactgacatgatatcttactgatcaaatgcagtcagtaggtatatatgaacttttttctctgtgaagaaaagctattaataagtttgacttaataggcctatagtatgcacatactggccaagattctaaatggattattcagcggttctgtttttgtggaggtgcttattctcatttctccaaagccttaagattcctgggaatagaggaaatgttgctgccaccagctttgctggtgaatttcaaagagaataggtgtttgctgtttgatttctagtgaccttttggcgagctctgatttataggtagaacatttgtgtttcttttcattttgaggccaggtggtagagtggaaagactgggagctgtcaggaaaccaaggcttggatctccactctgttatgtaccagctggggcaaatcagggcccattcccaactcctttaaaatgaaaggactagacttggtctttaagctcccttccgattctaacatttggtggtagcaggattgtgcacaaagctcctaatttagagaaagatctgggttttagtcttttctcctctatcgccgccttaccggttgtacaacattggaccagccattctccccaaggcctcggcattttcattgttaaatgggaacactcctaattcacactgttgctgtgaggattacatttggtaatgaatgatagaatgctttgtacatggaaaaggactatacctttcttttttaactacaaaggcgaacatgtaaccctctacctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccaccccagtgatttctccccatctccacctctatattatttgaactaaatgaattcatgaatgaacaaatgagtggatgaatgaatggtaatggataatgggctatgaagtcatatttaaaggcactatctcatttaaaaacaatctaaataaataactacaatgata

SEQ ID NO: 6763 - DNA, 2604 bp, Homo sapiens
tgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcagagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaagagatagtccactgcgttagtgacaagtggttcttgtctgtctcccctctcctgtccccgcgccttccgctctgcctcctccccctgtcgctgggaacccccttcgccgggtaggagagcgctgctctggctgataggttaatccaggtactgtagctttttatcccctctccggattccttcctggccccttccctgcaccctgcacatgacagccagtaaccgcctcttccctgccattctgcgggcaggcctggcgccatgcatggagcagctggggaccgcttctgggggacacagaggcttcccgggggggcggggcatgtgaagtggggagaagggtgtgtgtggaggggctgtgagtgcgtttgggtgtgaatgtccacatgcatgtacagaaagcttcctccgggcgacacagggtggggacccaggagggctggggaacctaaaaccatattcacataaggccctggtgtgtgcagtgctgcggtcacacacacacacaacacatgcacacacacacacgcacacacacgcccggccctcacgctgctgctctctgctcctacctgcaatgcctgctaccaccttctctagctcacctgctcctgctgccacctcatcttgaatggctttatctggaagctgccacccgccacctggtggctttgagcctggaatggggggcccaagttgggtaggggacaaagatgaggtgggggaaaaaagggggtcttagctccaggcaggtggaggccccagagcccaggactagagaagatgccgctgggagaggtgaatgccctggggagcccagccctctcctgccggggcctcagctgtccccagatcctcaccctcaccggcagagtctggcatgaataggcacaggtggcctcgctgtgcccctggataaggatcccaactggggcagagactgagagccagagtggggaaggagatggagctttccaagcccagggctagctctgttcctcccgggctcctccaggtgtcctattcctgcctgtcacccacccacgtccccaggcccagtgggacgctcatcccaggctctgagtacgggaggcccccacctcacttccccccacctccactctctgggcctccccctgtggcgggaggcagggccttgggtgggagccgagggtcacggcctccccctgccccctgtcctcgctgttctcaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggtaggggcgggtgtgcggggctgctgggcggggccatgacccgcgcccccgcccccgcccaacggttttctttcagggctcataatctgccccgcctcagcacctggccctcctgttcctttctggggtaaggggaacccagagacaagcgcagattctcccccagcagctccacattctgagacatcctgatatccatttcttgccacctcatagtgtgtctgcagtatctgacttcccaacccccagcctcagcacggaggcctctgaagaccgggctgtccctgcagggtttcctctgtgtcacaggcagcagacagggctgtgactccttacggaggctcttgcctgtccccagggtctgaaggattgttaggtgtccctggggggccagccatggagaatgggagcagggcagtccgggactgtttggggagctctgagccagcagggtggggctgagggggcaccttgagtgtcttgagggccatgaactttgggtcccatgatgggcaggcccatgagtggggccccaccccaagattttcttctcctgaaagcttttagaacttaactgcgacctggtgcagtggctcacgccttaatctcagcactttgggaggctgaggcaggtggatcacctgaggttaggagttcgagaccagcctggccaacatgatgaagccccatctctaataaaaatacaaaaataagctgggtatggtggtgcgcacctgtagtcccagctactcaggaggctgaggcaggagaatcacttgaacccgggaggtggaggttgcagtgagccaagatggcaccaccgcactccagcctgggtgacagagcaagactccatctc

SEQ ID NO: 6764 - DNA, 2187 bp, Homo sapiens
cctgtctctctcacggccagccccgccgcccgctcgcgtccctcgaggtggagcaggcggcggaggcagcgatggccgagagggcggcggcggcggctccccaggaggtctctgggtttcggtgtttccggctggctaaggtctgactcctcctccctccactgcctcccccgcccgcggagccaccatcttgacctcgcccgctggcctctgccgttgctgctgtggctaggcccggaggctgcgccgtcagtcaagcgaaccgcagagtccgcgcccactgcctgcgtcataatccagcgtcataatccagcgctagagacgctccccatgtcgtcatcacccatggttgccatggtttccgcccacctcctcagcttactctagcttcgtgccaccccgtggcgcatgcgcttttcggtagccgcgctttccggcgttggagttgcagcttcaccctcgcagattcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcggtgcgtggcactaggctgggtgtggtgggtgctgccgaaaaaagggttcctcccatccatttgcacgtcacccttcccacctcctgcccagatggacagaagtgaggacattcatcggccgcattttactaatggcaaggagatagcgactgaagggcaagaacctagggtttcctgtctttgatatttctcatctttgaggtaagtacacctggacagtcccttccttcctcctcagggctcatgctttcttgcctatccgtgtaattaatatgatctggctatctttgtctttgttccgaaacttcagctgcaaatgaaagtgtaagttaggtctgagtctgcactatagacctagctatcctaggttaaaggggataaaataggaatcaagaagcctggcccgcttgggctcccagctcaagtgcattctgcaatccagtttatattaggcctccatgtgggtggctatcctttatcaagatcccccccagggggaggaggattattagtcacattatcaaactcccctccaacccctttctctgcttagaggtatgtgtaatgtgtagtagaaagaccgaatccccacccaaaagtccttactgctactcatgtttttaaccttctgttctttaccctactccctaataatgaccgccatcatttatctactgcttaatggatactaggcactgtgctaagggttttatgttttacttcaatcttttcatcggctttattttgatagtttgttttatagaggaggaaacagacttaggtaagttacaagatgacaaggttactaccttgttcagttagtagtcagcagctagtatatccaaagatagtacgagtcagaactaggattataaactcagggctacctgaaactcacaacttcaggcatctttgatttcttcttttcacccacagccaattcttcaactaaattgtatccattctgttttcaccgtctcttgtactggtctcctttctattgtaactgtcatcatcctaactcaagatccttctgtagctttccccggttattggaatatccttattacgactgccaccttttctaatccagtctgtttactactgccgggttaatttccccaaactgcatgtctggggaataaccttgtggttatgacagaattcccaaaggaaagcaaacttggcaaggtgcaaagactatgaagacttagaacttaagagttctatggagatcttcagaaatataaattagctactcaacatatctgttattctgccctgattgcactgtaaagcaaaaggagagaggccattatggggaaaaagatccaaaaggactcatctaaaacacaagttgggtagaggagataggtgagtactattatattatgttcatggaaaatgagttcatgggctttcctctaatttttattttaaaaataaatgtaaatattaaataaaattttttaaatgaaca

SEQ ID NO: 6765 - DNA, 739 bp, Homo sapiens
tgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcgcgccgagagtcttaccagcaaggggtcctgtctgccaccatcctctatgagatcttgctagggaaggccaccttgtatgccgtgctggtcagtgccctcgtgctgatggccatggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaattgtgtgttgggcctggttg

SEQ ID NO: 6766 - DNA, 2087 bp, Homo sapiens
agggaagaaaaataaccacccagtttcccttcctagtcttagttcaattcatagagtgttgtgtttatccccaaagggtcttgtagtcttcactgcaaacatttgattctgatctactcacatacaaggaaatgtagattgccaagaccaaaactagaggggtgggcttcccatcagggttttcctgtgtggagatgacaggggaaacagggaggaaatcctaattatggcttgtcctcttccctgaattgctgtctacgacagtgtagttccaatgtaaacaaggtgggttggggatggtttgtatagggcaggaggcccacccagaagtcctacccagggaagagagggcccagaatctagttgcagcatttgcccagtaaccctaccccggcctttctttgtgtgttaggaagctggaaatgcaggctggtctccctttcttgcctttgtcactaaccccgagctgtcagccatttggaatcagaactgctttccagtgttctaagtccttatttgattacaaatatttggtgaatcaaagtaaggcactttggtcctaatttttgacctttggtcctaatttttgtttgtaagatgtggagaataaccctgaccttaccaggggtcctgggaatgtgaatccattcgtcaagtggttccacatctagaagaattttgcctatgccatgtcaggcatcattcaacacaaggccaactatctgctgccagtctggcataagatcagattgaaactgctaagtaatggtacatccaaataaacaaagttcttccaagagagtaaacccaagtccatcttatacacgtatttgttctgggttggtggggacgacagttcagccgagtccgatgttctagagcagaggttctcaaccctggctgtgaattaggatcatctggccagtttttgtttttaaatcagtgcaagggccctcccctcagagattcagattcagtagcttcaggtgggacctggaatccatgctttgtttggaacctcaggagtgttcttgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttggagccttcgaggaaagagaagggtgacttgggggtatactatagtcgtggcccatatggaacacacaggcagccggttttctgctacctgagccttggagaagatgagaaggaagggctgcctgctgtgctgccctttgaaaaggtccaaagcagacaggagcgcacacagcagaagtcaccttctccttctgatgaccacctttcaaaaggcttaacagaatcaccaagtgtcacagtcagctcttggccagtggaaaattgtctgggcctgtatatgttggaggaactcagatagaaaaggacttgtaaacagcatggaaacctcaacatctgctgtctcaagcacttaaaaaaggctacaattcaggtgttactggatgacttaactgcatggacatttaggggctgacttgtgttgtgattattccaattgtgggctttggagaagcagagggatgattttcagttgtgtgggtgttaagtctatggattgggaatttaccactgaaattgatcgttcaaagtgtgacttcatagtagggccagctcctcctaagttgtccttttgtttttcacataaaatacatctggtactttttacttggaaagttgtactatgtccatgaaaatggttaaatgagaaggccataaagattcatttaatagctgaaaagcaacttttaaaatagaataggacgaatttaacatggaatgatgtgaccttctagggaactttttatagagagcttacatagtgtaattggggagaattttgtcttctatttccattcaacagtagcaaa

SEQ ID NO: 6767 - DNA, 629 bp, Homo sapiens
cggtctctttgtaaacatgaggcccgggagtggttccagaacgtccatcatggggctgcgagagcaggagggatggggcgtccatggtggcgggaggttctgtaagtggcggtggccttgatggatctcagcactgaggtcgagttctaaagccagagtgtgaggcacagttctgtcgcgtcacactggcttccaagtcccatggatctagccttgagaaggcggaaggggagacttgagttctgctgggtcttggctgcgtcgcctctgccctggggcgtgggcagggctgcggtcttggagggtctctcttttcctttctgtgatgagcgcacagctggggccgctccaagccgctgttctgccttccttttcctgcccctgttacctgggcagcggagggccgtgcggcccgggctctcagtgagtggctttccctgcttccctcctcccagcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcag

SEQ ID NO: 6768 - DNA, 1473 bp, Homo sapiens
ctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaatgcagtggcacagtcattgctcactacagcctcgactcctgggctctagcaatcctcccacttcctgagtagctgggatgacaggtgcgtgccaccatgccagtaatttttttattttgtagagatggggtcctgaacgcatggcctcaagtgatgctcctgcctcagcctcttttattatttgtttttagacgaagttttactctgttccccaggctggagtgcagtggcacaatctcagctcactgcaacgcctcccaggttcaagtgattctcctgcctcagtctcccgagtagctttgactataggcgtgcaccaccacgcctggctaatttttgtgtttttagtagagatggggtttcaccatgtgggccaggctggtcttgaactcgacctcccgtgatctgctcacctcagcctcccaaagcctcagcctcttacagtgttgggattacaggcgtgagacactgtgacccgggacgattttcaatcacagttttttgttacgagtggaaaatgcgtatttataagaatgaagtagtacagacatgaatgtgtagaaatctctataatcctgccatccaaggatggcacctgttaatgtgtatatcagggatgtccaatcttttggcctccctgtgccacactggaagaagaagaatcgccttgggccacgcataaaatacactaacactagcaatacctgatgagctaaaagaaaaaaaatcacaaaaaaacctcgtactgtttgaagaaagtttacagatttgcgttgggccgcaagttggacaagactgctatatgtatattctaggttttcccctataggtatacttatgtgaaaatgattattgtgataaattttgttttgagatgaa

SEQ ID NO: 6769 - DNA, 505 bp, Homo sapiens
cggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatggtaacgtcactccgcccccaggtccagtgttgggggcgggcgacagggccctccacatcccctccaccacgggcagctgctccctcaaccccggccacctcccctgggaagcgcgaggatcggggcctgttctccattcagccggcccctgctgggctgagcctgcctcgctagcctggcagatggccgaggcagtggccgaggtgccaaaccgccgggttgcagaccggccctgccag

SEQ ID NO: 6770 - DNA, 2378 bp, Homo sapiens
acaagggtacccacaagtcactacttggaggacagtgcctctttgaggcctatgcttcaagactccagcctgccggccttcgcatgcttgctggtcgtgctcacagtagctctctacaccctggctgtggcaaactgagtctcatcacccaagatgaagtggcttcatttggtgccgggtgccacccaggcttggacattccatggcctcaagaccacaggctaccaccaagtggactcttgggtatctggcaggatgagcacacagctggctgctgggcatgggtgaggtcaagggcatgaagcagtggacagcacattctttgtgatcatactgctcctcctgccccacggtggcctgacatcacagcctgctgctagcttatgagggtctgtgccgtgccccaccaatgcctagccatctcctttcccatgagttttgcccagaccaccatcagccctgttgcccgcccccaggtctacaggaacctccatagccgcttgtggacccaggtgggccacctgccaatgcacaggagagcccctaatccccaggaactctgccaaactggcctatctgggcatgtgagtgaggcaggggcaaggatgggatcccctcctgagccccagttactggaccccacagaatccaggtgctctgccagcccccctgcctctacctgttaggctgccaagctgtgggtgctggggagggggtcttcctggtcctggggcctgtctatccatacccagatctcacaccatttttttctttaaatgatggcttagaaacaaaaaataacaactgaagaaaaagattttttcttaaactcaacaagaaagactttcgtgttcagtttgcctctcttcgtctccagagagggagggtttgccctgtagactgccagcattctctcttcccctataccttaccctctttagcaaggcctagaatcttccaaaggggacagtccaaggctgctgaacagagagaccaggaagtccccagagcggggatagttaatattccattttatgctgtgttcttttagactaaccccaactctttcttacccttccaccaagtccgaacccctctaggtataagagctgagctgcccaccccctcctccccctgcttgcagagctgtctgtctccatttcattttaggggaaggggtggtagtggccatacccaggccccttcccatggaaggccttatcttctgttccctaggacctggggaggccttatcacaaaataatgtggagggtgcttttggcagggaagtacaaaaggaaccagagccagctgaaaaggcaggatggctgagagatggtagaaggaggagagcccttgattttggttaatacatagagacagggtctcactatgttgcccaggctggtcttgaactcctgggctcaagcgatctgcccaccttggcctcccaaagtgctaaaattataggtgtgagccactgtgcccatctgattttttttttttcttcaagacagggtctcactctgttgcccaggctggagtgcagtgatgcatcatagcctcaaactcctgggctcaagtaattctcccatctcagcctcccaagtagctgggactacaggtgtatgccaccatgcccagctttttaaaaaacatttttgtagagacgggggtctcgctatgttgcccaggatggtcttaactcctgggctcaagggatcctcccaccttggcctcccaaagtgctgggattacaagtgtgagccaccgcgcccagcccttgctaacatttttgattcgccaatatgttttgtaaactagaagaataacagaacactgcaactttagaggttttctctcttggtcctaccttgtgtatgtagaaagttaatgtaagcttttcttctgctgcttttaagtaagaccctatgcatcccctcctgtgtttcagcccactggggcattatgctgtaaaggcttgcttgttgcttttagttgagaacttttgcaagattgtcagtgtacattttttatgccacttggaaacttatgtgactattcacaattgttatcaggttgttggggcctttaccataatcttgtacttagaagcagagttctggttttgttggacttcagactggaagctgtgcctgtgttctgcaaggataacctccagaaagaattctgtgaccctgatggtcttgatgattttgtgccaggttgtaattgacatcactgtaactgacaatgcttcttttaagcagagaaatattcctgaggtggctttgtccagtcacaaggggatctgtgacacttttgttttctatacgcatgataaaaaataaaaaattgcctgtctggggaaaaaataa

SEQ ID NO: 6771 - DNA, 2202 bp, Homo sapiens
tcacatttactctttaaagcaatgctttgaggttgtcttttcactttcttgctaatgtccttggatgatccacaacttttccaaagcaggccaagctataaataaagggtggactgaccttgtcaactgttaaattggagccgtggtgcgttgcctagaacattgcggatgaccccgagcagcacagcagatcaacggctgagaaagagctcattcagctcatctaactaggatgctgtcctgccagagccctgggggttctcgtctcctggggcaaaagcagcatgcaacccttatgaacccatttcatattggcggacattgaggcacacagactgtatgacttgcccaaggctgcccacctggttaggggagctccaggattccaatccagtccgaactcaacacgaggggtggcacctacaggctggggtcaatctggaagactgcctgttgtatggcctggcaactaaaaattgttttttacatttttaaatggttgacaaaattaaaataagagaatatttcatgacatcatcaaattacacgaaatgcaaatttcagcatctacaaatacagtttgattgggacacagccaccctcatccgtttgcaggctatccctggctgcttacagggtccacatagtccataaagcctgagatatttactatctggccttttacagaaaaagtccccaaacactaatctgaaatgtttgcatcagaaccccttgtggggcttgttagaatgcagctccctggtcccacacccagtctctgattcagtaagtctggagcagggcctgggaatttacatttcaaaataatttcccaggtgatgctcatactggtccacagaccactttgagagccactaccctaaaccccagtgctctactgcttgttgtcaggatggctgggtcaggtgagaaagaagcctagacatccctagagccacctgctgtgcagccaccttttgagaaagtgtccccagtgatcttttcccaggttagcctttgtggcttgggcatccagcctttcagagatatgaaaccacacacgtcttcagagtgaacagctgctcaccccgatgtgctcaaggggtgcaggatgtggacacatcctactgaatgagccagacaacgtaactggatctgtccagaacaccacgatgggtgacattgccatctgcagcagtgctgtacttcctcccgccaatttgtaaagtgcagacaggatgctggatcaactggctgctgctgaggccagtgacctctagggcgtattcccacgttcctttgcagtagctgctcacctttgtaagcatgtgagttattcgtgctgtctgttgtgatcctaaggaatccaatggtcaggaccagaacttctgaagtacagcccagcattgccgtctggcatccccagaaagcagattttgagattggcatgatggccgttaagcagggcgttctctctggagcaatgtctagccggggtcggagtggggagagagagaggggggctgctgagaatatcacagagagatggcagcctttctgcagcataggcctaagtgcacactcacctggctatcactgagaggactctctgttcaacagggccactcagggcttcccctgcatggagatctgagtgtccagggaggggacgtggtgagcatttctctggtcaaagtgtgcaaagcaaaatctgccccattcctgccaaagtggttgacatggaggaaaggggagtgccagttctgtaggctgaggtggtggctgttagaactgctcctaggctagttggtgttctggaaggttcccctctatgtgagatgaaagagcatatctttaagagctgcaactttgaagctctaatatagaatgcttttggtggcaagcattacttcggaaagggcttgaagacccctgaagatccttggtggcctaggcagttcctttattgccagggctgtgcaggactaagcttcaacagcgccaccatgtgacaagaagcaattgcagtggtgcattgagggttttcttttgcactgagaactcaagtcccactttcacccttggacctggtaaatctttggggttcatggacaattctgaggaggagatacttaagagagtgatgttagaatttgatgttttggtttattgtatcagaaaataaaagaaattggatttata

SEQ ID NO: 6772 - DNA, 1408 bp, Homo sapiens
ccttaatctggtgccggatggggtggggcacggtgcgggcttccggcggaagcgctggaagcaagatggcggccgccgagagggttcacaaaggctctggtccattagaggaaggaggtcccagaatagctgggaaattacgagaacagcctcactgcacgagttggtgaatgctgtgatggcgattgtatgatggacggtgatgttgaaaccagactggggaatgaccgccccatccggagagtttggtcagatgaagactgggtggagaagtttgctgggaagaggataaagaggaaggtggttgagacttcccaaagcagaaagccaggaggtaagaatgacagttcatgcttccataggagaggctgctgctttccacatagggaatttctgaggtgagtggtgttgggtgaatttaaaggagaagttttggctttcttatctaggtgagaaatatcttatgtgggctcaggtatttgtgattgctgctgagcaaggcggatatctgaggtgagaaaggatggtgagtactctgcatcaccagcatccgctatcctcctagtctttggcagcaggctcactgtcttcctgttcttgccctaattccaagggggcagaatcatgtagaggtcccttcccctcagtcagtacacaggcacaaggctctccctgccctctccacttgctcctgcttctccatcaggccatcctgactgttgcttcccaggataatttaagggctcctcctcctcagtccaccctttgagcagtgatatttccctgaattccttccttagccctcagcacctctctccacattatccttatgccatgtcagccccttctatctcctaaggttataacgatctttcattgtccgaatgatattctgatctctatccctagccctgacctttcacatatttctgtttgggtgtcttataggcaccataaataaagcatatcccaaatgggtttcatcacctttctggtctttttttatgcccaatcttagttcactttgccatcttcaacatagtcacacccaaaccagattccttggtgccagcttagatccctcactgtatttcatacctaatgcattaccataccctgctaattttatcttttaaatcttgcgtttctcctctccagttttcttctgccactgttgtcttggctgaggccttatcctctctcctgtgaataattggagtagcttcctaactggtctccctgccccaggcctgttttcctcctatccttagcagccagagggagctttctaaagggcagatctgactatctcactctccttaagcattctagggactcccttgatttataggattgagtccagcctccatcaaaagggacagaagacctctctatgttctgattcctg

SEQ ID NO: 6773 - DNA, 3306 bp, Homo sapiens
atcagtgagatcaaacaaaacatacccaatcagtgaagaagccaggccagtcccaaaaagccattggggggccagaagaccctcatccatataccaccagataaccagaaaaacaaaaacactgcacagctgcgggatcaccacactggactcaaataccatagcccaatattggtatttccgagcatggatgtttttccagagctcttccaggaaccgccggtccacaaagttatcaggaaagggctgttgctcatacaagaccctctgccactttacctccttggtgtttgttacaggttgggtacacataatcctttcattcaaactcaggctagtttaatcatccctctcacagaggtccatgtggttcttgttgatgacattttgaaatgagacctccctggaaattccatgccttggttgatattctgctgacctttccttgttttcaaaggcagcaatccaggccaggcctacaatagatgagtttgtctctgaggcaggatataatacagccaagttcctggggatgcgtgactgggagatggcagttgcctgcctttttccttgtaagggttttttttttttttgagatggagtcttgctctgtcgcccaggctggagtgcagtggcgcgatctcggctcactgcaacctctgcctcccaggttcacgccattctcctgcctcagcctcccaagtagctgggactacaggcgcctgccaccatgcctggctaatttttttgtatttttagtagagacggggtttcaccgtgttagccaggatggtctcgatctcctgacctcgtgatccacccgccttggcctcccaaagtgctgggattgtaggcgtgagccactgcgccctgccatgagggtacttttaaagaagataacatcttccatggtgtattcaatgaggtcgtgtctggaattgttcccttaaggtggaggctgctctgtggccactgtgcctggcggttgtatgatcctgggttcctgggcagagaagcctcagcctcagagtgtttggggccttttcctgccgctccaaggctgaaggagaggagcttaaccccaactgcacagcgctgatcaccacttcctgcagtcattcttcctaaatctcaaaaactcttcttttgtaagagtagattcttgcaagatatttttcccctcctgagttcttacattgccagagttccatttggaccgtttgaaatcttgatgcatgaataactggcttcacagactcttggccgcccactacctcggtgtccactggtggagttctgcaactggcaaaagtcaagaatgaaggaagcaaacttcagaaccacaatattcatattgaatcattttgttgttgctctatgaagataagctaattttcttcctggaatctcataggattattactaagggccagggagatccacttcgttcatttagtcactcaggaagcattgctaagcatccccctgtaccttcccctacagctctccttccaaaacgaaacatcctttggagtgtgttgtcctccagaatcgaatggattctatatgctgcattcagtaacaggttgtggagacaagtgtcttttcctgaaattgctaagtgtatttggcagtactttactacttgtggatagaactgagagtgaggtcagtatcaccaagcctcttggatttcttcagtagtctcatggataagtgaatgtttaaagtaactactactttgttggctcttggttgggtggatggattctcagtcctggtgtttttaaaaatctcattccagccgggcgcggtggctcacgcctgtaatcctagcactttgggaggctgaggcgggcagatcacctgaggtcaggaattcgaaaccagccttaccaacatggcaaaacccatctctattaaaaatacaaaaattagccgggtgtggtggcacgtgcctgtaatcccagctactcgggaggctgaggcaggagaatcacttgaaccctggaggtggtggttgcaatgagccgagattgcgccattgcactctagcctgggtgacagagcgagactccgtctcaaaaaaaaaaaaaatcgcattccgtctaaagcaagctacaaaatgtgattatttatgtcacgatatgacccagccataaatgtacttcaggtaagaaggacactgacatgatatcttactgatcaaatgcagtcagtaggtatatatgaacttttttctctgtgaagaaaagctattaataagtttgacttaataggcctatagtatgcacatactggccaagattctaaatggattattcagcggttctgtttttgtggaggtgcttattctcatttctccaaagccttaagattcctgggaatagaggaaatgttgctgccaccagctttgctggtgaatttcaaagagaataggtgtttgctgtttgatttctagtgaccttttggcgagctctgatttataggtagaacatttgtgtttcttttcattttgaggccaggtggtagagtggaaagactgggagctgtcaggaaaccaaggcttggatctccactctgttatgtaccagctggggcaaatcagggcccattcccaactcctttaaaatgaaaggactagacttggtctttaagctcccttccgattctaacatttggtggtagcaggattgtgcacaaagctcctaatttagagaaagatctgggttttagtcttttctcctctatcgccgccttaccggttgtacaacattggaccagccattctccccaaggcctcggcattttcattgttaaatgggaacactcctaattcacactgttgctgtgaggattacatttggtaatgaatgatagaatgctttgtacatggaaaaggactatacctttcttttttaactacaaaggcgaacatgtaaccctctacctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccaccccagtgatttctccccatctccacctctatattatttgaactaaatgaattcatgaatgaacaaatgagtggatgaatgaatggtaatggataatgggctatgaagtcatatttaaaggcactatctcatttaaaaacaatctaaataaataactacaatgata

SEQ ID NO: 6774 - DNA, 5715 bp, Homo sapiens
cggccgctcagagcgctccaggctgggttcccgggccccgccgcgccgcctccttcccagctcgcccgcccaggcctggcctcctgcttttccatttgattccctgcctctttctattcggactggaatgccgggccaggctccggggcgcgccgctgcggcagccgcacctcgcaggtcccccggccgaccccgacgcggaagcggcggccctcctcgccgtcggggagccagggagccggggacgatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcataccttttaatggtatatatcctaaaactgaagtgttcaatatagacatccagattgaaactcaggcagtgaattacatacacaacaaatcagttgaacatggcagagcttgtcagacttatgaaagattaaatacattttacatttccacaagtgtggtattcacaggtctaaattggaaaattcttgggttgaagaagaataatcataatcttagcttcactcattgaggaaacattattcagggatgataagaggtaaaatcttaaaaatattgacaagctaatgagagaactttgaggtaagctgatatgcaggtatagttaggactgggaaaagcaagaaaatggaaggatgggttagagggtggcactacacggctgatatagtttggatatctgtccccatccaaatctcatgttaaattggaatccccaattctggaggcagagctagaaggcagagcctggtggaaggtgtttgcaacatgaggaaggatccctcatggcttggtgctgtcttaacaataatgagtgagttctcccgagatctagtcatttaaaagggtgtggcacctccccccccccccgcccccgccaactctctcttgctcctactctgccatatgaatgtttgttccccctttgccttcagccatgattagaagcttcattaggactcctcagaagtagatgttggtgccatacttcctgtatagcctgtagtaccatgaacctcttcgctttataaattacctggtcttggggatttctttatagcaatgcaagaatgacctaatacagaaaactggtactgagaagtgagtcattgctgtagagatacctgaaaatgtggaagcagctttggaacttggtgacaggcagaagttggaagagtttgtagggctcagaagaagacagaaagatgagggaaagtttggaatttcttagggactggttaaatggttgtgaccaaaatgctgatagctaggacatgaacagaatgcacccaagcactttgctaaggcaaaacatgcgtgacctttgctctagttcccaataatttccttatttccattcgagacctcagaagcctggacttcaaaccaaaatgctgatagtgatgtgaacagtgaagtccaggctgctgaggcctcagatggaaattaggaacttactgggaactagagcaaaggtcacacaatgttaacgccttagcaaagagcttagctgccttctgttcatgccctaggaatctgtggaagtttgaacttgagagtgatgatttagggtatctggcagaagaaatgtctaagcagcaaagtgatcaagaagtggtgtggctgcttctagccacttatattcagatgtgggagcaaagacaaaaggtagaacttatatttaaaagggaagcagagcaaaaaaagtttggaaaatttgcagcctggccatgtggcagagaaagaaaaaagctttttcagtagaggaattcaagcagactgtggaacaattacttgctagagatgtttgcaggattaaaggggagccaagtgctactatccaagacaatagggaaaaagccttgaaagcatttcaaagaacttcagagtggcttctcccatcacaggcccagaagcttaggaggagagaatagattcatggactgggcccagggccatggtaccttgcacagccttgggacactgctcaccacatcctagctgctcctgttcccactcttgccatggctcaaaggggcctacatacagcttggactgccactttggagaatgcaaacagtaaaccttggtagctttcatgtggtgttaagcctgcaggcacacaaagtgcaagaatcgtggattcttggcagcctctgcctagatttcagaggacatatggaaaagtctgtttgtccaggcagaagcctgttacaggggtggagcccttacaaagaacctctactagggcagtatagaggggaaatgtggggttggaggctccaacagggtcaccgctggggcactgcctaatggaactatacgaagtgggccactgccctccagacctaaggatgatagatctaccagcagcttgtattctgcacctggaaaagccacaggcactcaactgcagcccatgagcgcagccttggattctttaccctgcaaagccataggggcaggactgctcaaggcctggggagcccaccccttgtaccagtgtggcctggatgtggaacatgatgtcgaagattattttggaactttaagatttagtgacttccctactgggttttggagctgtgtggatcctgtagaccctttcttttggccaatttccccctttttgggatggaaacatttacccaatccctatacccccattgtatcttggaagtaaataatttgtttttgattttacaggcttataggtgaaagtgacttcccttgtctccaatgaggctttggactttggacttttgagttaatgccagaatgagttaagattttgggggcctattggaaaggcatgattgtagtttgcaatgtgagaaggacatgagatttggagaggccagaggtggaatggtatagttcagatatttgacccagcccaaatctcttgttgaattgtaatccccaatgctggaggtggggccttccttgtatgatgtgtttggaacatgcaggcaaattcctcatggcttggtgctgttttcatgatagtgagtgagttctcctgagatgtggtcatttaaaagtgtatggcacctccccccactctctatctctcttgctcctgctctgctatatgagacacctgttccccgtttgccttccaccatgattgaaagctttgtgagacctcctcagaagccaagcagatgccagtgccatgctgcctgtatagcctgcagaaccacaagccaagtaaacctcttttctttataaattacttagtctcagatatttctttacagcaatgtaagaatggcctaatacaatagcctaaactaatttgagggaggtgatgtgtctcttgctacacaaagtatggttcatggactaacagcattggcgtcaccaggaggttgtcagaagtacagactttcagttcccttcccagacctaataaatcagactctccaaaaagttttgggagcactgctccagccaatgacttgtggtagaattctgtttttgcctcaacagcatccattctcctttcagtaacaactcctagcttctactttggggaactttccatctcccacactcagacctagggttcagatgtggctaacctagccctgtgcagccagaggaaggcacatgatccaggcctggccaatgacagtgccttatgacccagccagagtgactggttcagcaaagagggtgtaatatgagctgagccaatgagacttagtcctggtacttttgggaaagaaatgctccccttcctgagtttgctgagctgataagatattcatctacagcagccatctttccactacctgagaatgaagccaacataggaaaatggagctgagaaatgagagagatcctaacaaattcatttatccactcactaccggatctaaatcctgggctttttagtaactcaagccagtatagtcttcatttctttggccagttcaaactggatgtctactagttacaactgaaagaatcctaatacatcagtctcttcctgtccctgaaattcattaggctcattttgaatctttgatatttccttttcctctcttctttgtctgtgtttaatccattttgcattgctgtaaaggaatacctgagactcggtaatttataaagaaaagagatttatttggcgcacagttctgcaggctacacaagcatggcaccagcatctgctcagcttctggtgaggccacaagaagctttaactcatggcggaaggcggagggagagcaggtgtgtcatatggcgagagagggagcaagagagaggggagggagacttctctttttttggcaatcagatctcgtggtaactaataaagcaaaaattaattcattactgtggcaaggacaccaagccattccaaaaagattcacccccatgacccaaacacctcccaccaggtcccacctccagtgttggagatcgcatgggagacaaatatccaaactatatcactcctctctaaaccagtttagagggttcaaactttgccttctccagatttgcctcttccctgagaccttccctgatagcttcccacacatactgctctccccagtccatcaatgaattcctgcatccaggtggctaatggttccatacttacccttcagctgtgaccagttttgtgtccacctctgtcttcctccctctttttgcttagatgacacccactcaacctctagatgtcccctgctacaggtgggatgcccttgttatatgttcttatagcaccacctgtcttcccttcatggcacttatatttgtaaatgtattcatgccatagagtactgcatgaaggcagtcgagtgggtggttcaaacgtagaccctggtgtcagcctgcctggactagctatatgaccttgggcaagtttcttaacctctctatacctcaatttccttacttatcaggtgaagatattaagagtacctcctcagagtgtgattttgttaatttatgtaaagtactgagaacatgcctggcatgtaataggcactgtataagtgatatctattattattgtacatgggattatttgatgtctgtatcccatcccccatcagacatgaaaaaataggtctgcttttgatcaccattttacacttaaagaaaagggtcaggctgggcatggtggctcacacttgtaattccagccctttgggaggctgaggcaggtggattgcttgagcctaggagggagggagggaaagaaaggaagaaagaaagagagagagggggagagagagagagaaagaaagaaagaaaagaaataaaagaaagaaagaggaaa

SEQ ID NO: 6775 - DNA, 1783 bp, Homo sapiens
cgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagagtgagtgtggccctgacagcggggagggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggctggggagcggagaacagggaaggctgcttgtctctgaaaaacccctgccatgcctgatggaagaatgttggcagctactggaaaggtctcactggtgccagtggttctggtggggtggtttctgctgcccccagcactgtcccgagggccacccaccaggtggcagcttctgaccagaacctcccctattggggtgagccctgaaggggggaagaacttctgccagccccagacttctgtggcagagcagcaggtacaggactgggggtctctggcacccgcaccagccacgttcccagaccctgcaccaggaccctaggtgagggcccagggcaagcccctctgggatggccaggctacctgcccagcctccagggtcctgctgcctccttgcccaagcattgtttctctggttttaagcccctccaatgggcctcactgggggcaggagatcagccagggcccctggtggccaagctagtgggaaccaggctcgtctttaggcccaccctgtcactctcccgtccaaggccacatagtaggctgaggatggcaaacactgccccacagacacctacaggtacgtatttttccaggaagctgcggttctggaacctggagtttgagagccagtctttcctgtatagacaggtaggctctgttctggggccgtccccagggggtggggctgagggtgggcaggcccctgtgcagtcttggctctgggtcgtgggcggctctgggtcacaggtacggaggatgacggctgtgctggtgggtcacgggcggctctgggtcacaggtacggaggatgacggctgtgctggtgggtcacgggcggctctgggtcacaggtggctctgggtcacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctgg

SEQ ID NO: 6776 - DNA, 4427 bp, Homo sapiens
gttctgcagcatgggtgacaaagtgagacttcgtctcaagtaaataaaactaaaatttttaaatcaaacatgacaaaaatgttaatataattcagaagtaccttgaaattgaaacatatttgtgcaatgatcattaggctttttgtccttgttgttttaaaatgaggcttatacagagtgagttgagagtcaagtagccttcgctgtgagacggtaatgcagttatataatagatacccttgactttgccagattcatcacaatactgcttatacaggaaagttttctcagaaaggaaaatccattagtatcagtcccatcaagccaaacagaatgaagacctttgatagtaatagcaagaggttacaaatagcagggaggaggcgagtagtgaatgtcactgtgattgcaaacccttacctgtattatcacacgtagtcctcacaacaaccttgtgagacaagtgttgtgttcctcattttttcagaggggaacacagacccagagaggttaagaaatttgcccaagataacaagtaaaaggcaaagttggttgcaaaagaggtgtttctgaattcaagggccatactctctctctgacaacatgctctaagtccatagagtaagcactctagtatgaaaaaaagtttcaaggaacgaggccatgaaaatgagactatttgacatctcagatctgtctgggatgttatggaggtttttaaaaataaagttgaaaaaagaaaatgaatcatgtttatacataaaaaaatcacatgtaacacatttcaagtgtttgaaaataaaaccaaaatctaaactttagtcttcaagcagacattcagtgttactttagaaaactcactgaattaggtggaaatgatggaataatactattcatggccagctattaacacagaagaacatggcagtgtgtgtctggaacggcatgcacaatttgtaaacctttttcaaatatcatttaatcaactcagaataaagtgccctgtagccaacagtgcctctttacttgcttctctgggaaatacatggtactaaattagtagcacaaagtttgggaatatgcaaaataatggataaccatttttcaaaatgtacattctctgaagaggaagcagctggttggacaggatttcttgaagagccaggtgctaagggcatcaggtcgacatccatagtaaccatgtgccataacatctacacatttccacttgttttacagacaaggtaacaggcagaaggaaaatccagagtcttgcagtaagcagatgacaaaacttcaatatgcttgggcaccacttaggtgaccccagggagatttagtgtggccttaggaaagcaaaagagcactttttattggaaatatgagcttgtcactgggaaagatttgtaaaattgatcaagaacttgatttataattatgcctcaaaaaaaaaagttctcatttagtagtggagcaatctagaaaacataccttttttgtttgtttggaagatcctctttccctggctgtattgtagtgtttgctatttgatgtggaaataactaataacttaagattttggaacagaacaccctttagatttccaaaacacaattcttatttcagggaagacagaccaaaaatatctcctgagatcattggtttctttataaattgtggtaccactccatcattgaagagaaaccactaccacaccactagcaccatacagaaccttttctctgtatctttgtacaatactacaaaggggtaccagggaggagagagtggctgaccactttagtgacaaaacagcactccactgctggtgaatcccatctaattatggtccttccacccttttcaaccaccaacaactgttcgtactgttaattcctatcctgaaggtttaaccagtggttgtctagtatcttctgtctttagaacagtggttctcaaactttagtacacatcagcatcacctggagggcctttttttaaaataagacacagattgctgggctcatggtcagagttcccagttaagtaaatcaggaaatttgtatttctaacaagtttataggtgaggccaatactgctgttttgggaactatgctttgagaaccactgccttgaaaaaatttccaacttctacctttaagatcagcctgacttatcaaacgctagagaaaaactgaatctacccttgggcagatgacttgggattggattctatacagcagtcttgctcaatcttcccagtttccagttttattataccaacaattggtttttacaagctagaagacaatgaatgtataagttctatggaacagtgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagccttggctcctggcttacagatttttgaatagttgtttgcttgccagttgttttacatctttcattggccaccaaaatattagccatttgagatgagatgagactacttgttgtaccttcatctttcatttaattttctggcgtaaattaacattttaatttcatatatatctgtaaagagtctacccaaaggcttcacggaaatttgcaaaatgaactaattcccttttaagcagcaggtgtgcctgtttttgacttttcagtaaatatgttgtttgtgcacatatctacatggtggagaccatattcattatttcatcttccaaataatgggaaaaatataaaagtgaatcagtgtgctttgggaattcagtgaaatcatgttaactcatatagagggggccttagtttatctcttctttactgaattaattagttttggaaattcttttaccattaaaaaaaattaaggaccatacagagaatgatttaagaaaaaacaagtcacttaaaaatcatcacctatttataaactgtattaattacacataatgcttattgattcaatgaggtttctctaaagacttctgcttaataaatatgctgacttcatttaaattagtttagactattgtaggaatggaaggaaatgattatatttactagaattagtgagatcagaaagcatatcagaatgttgatgatatcaaggagacaatctacagagtttttgcctctgtggatggaaataagggtgtttttttttggttttttttttactttagtttcccataatttttggaaattatgtgtgcatttagttcttttagtaacactgattttaaaattaaatttcaaaagtcaatctctaagagtaatttatttttgttttaccaaccagtgccaaaaaggagaggagggaatccaaaagccaatcttttgaaccaatgtgtaaaagattatgttttttcttaaagttagggaggctcgggccctgacactgccagccccagtgagcatccctggctacctcgggattatgtgcaagctgctttgtcctacatttctttcatctggttcttattgggagtgcttctctctaataaaaattgatttcccacaaaataggcaaagctgaacaaagatgaatgcttttgataagttgggtttcacttcagttgaaacaatgtgatagaatatccaggtgtggcatgatggggcaggaggaggtgcctagagggaaaagttatttttgtttcttagtgttgtgttgtggggatgggacagataagaataagatgtttattgccctaatcatgctaagagactattattcaatatgcttttcccgcttttctaagaggaataaacttagacaaattacattataaacagttcccctactactatctcccactctagataaagccagtgggtggtatgggtccttttattccttatagtattatgccaaagaatcaacttattttcattgaagattataaataaatgaagcttgttatagccataatgatttgagtcagtataccattttacctataaaatgcaaaattcatccttgcaaccccattcaccaggagccttgaagcattttgtttactccaaaggccttgtcaaggaagcataattttttgttttgccttcttatttagtcagtttggtcatatttacttaaaaaaacaaactgaaaatcacactcctttatatgttgatataactgattttatagaatctgtctgttctttgtttaacaggtctctgtaagcaagcttgcaagtgtattttgtgtacattttatctgaggtggaaatgaaaattctaaagagaaaatattttaaaagatattgtatttatgttgcttgtgttgtagaataaagattcaaatgcatt

SEQ ID NO: 6777 - DNA, 1710 bp, Homo sapiens
ggcttttatcttgagaacatggtgtctggagttaaaggtatgtctcaatttgagttttcacatcatatttgtttatgtgtaggaaacagtatgttgtcagagcaagtttcattttattcagggacatttctaccatgcttttaattcccatttatactgatttctgaaaagaagaatcctagattcacacattttatagtgatgtgtcagattcattttagttgcaagcattagagggtcctgaatttgttagtttgtagcaataatcagaactttggatttcctacttgaagcctacagcattattttgaattaatgcacaatctaaaatgaggcagaggattttatggtttaatgcaaaatatagtataataaaagatgattacacaggtcataagaattcataaatttgaatgatgtagagtttgattaaaagttatataatgccaaagtcgtaacttacaggcacattatattcctgtattttataatggatgacaattaattttgagccaagaattaaaatttgctgaaatcttcgaattgggaaaacaacatcctctgttgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacac

SEQ ID NO: 6778 - DNA, 2549 bp, Homo sapiens
ttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatggtgagtgtgcagggcagggcgtcccaaggctgtggaggcctcatcggaaccggcgggaaatggcggcggtgggaggagtctgtgaatggagttcccgctcagccctctgtcctcagtcccctccggtgagggacccgcgctcttgtcagtccccgtacagcggctctggcccagcctgcagccctccttgtgcagctctgcgccggtagccctgcactttccccgggctgtggagtgagtaggagctcatccggaagacaccgcggcggcctgcgcggtgccggcgtgggaggagctgtggtccggaatcccgtccctactttaccctgttcagaatgagattgaggcccatcaaaacatggagttcatgtgagcaaaacaggacttattaatgggaaagctctgccgtggctcgtggtttggggactgccagcgggtcttgaaggaaaggcttttgtgaggtgtgtgaggaagcgaagcaaatcacctgcctgcgccaactttgccgccagtccccttgccctgtgcgcctcctccgcgtggctgttcctgaatacgctggtgtctgttcgcatcttttagaatacgctggtgtcggtgcgcacagcgcttctcttagttctacggagtcttcgctgtgtcgccaggctggagtgcagtagtgcgatctcggctcaccgcattctccacctcccaggttcaagcgattcacctgctcagcctcctgagtagttgggattacaggcgcgccaccacactcagctaatttttttgtatttttagtagagacggggtttcgccatgttggccaggatggtctccatcttctgacctcatgatccaccggcctcggcctcccaaagtgctgggattataggcgtgagccaccgtgcctggctgaagctgtgtgttctcatttcacccaaaacctttggacagtgcagggcatagaagattcattccacaaacttataccaaaaggacatgagaaacgtggacatgagaatttaagaaaaacttgtaaaagtataaatgagtgtaaggtgcagaaaggtggttataatagaattaaccaatgcttattaactacccagaaaaaaacaattcaatctaatatatgtgtcaaagtttttcataaattttcaaattcaaacaaagataagataagatatactggagataaaacctttaaatgtaaagaatgtggcaaatcatttcacgtgctctcacgcctaactcaacacaaaagaattcatactggagagaacccctacacatgtgaagaatgtggcaaagcctttaattggtcctcaattcttactaaacataagagaattcatgccagagagaaattctacaagtgtgaagaatgtggtaaaggctttactcggtcctcacaccttactaaacataagagaattcatactggagagaaaccctacatatgtgaaaaatgtggtaaagcttttaaccaatcctcaacccttaatttacataagagaattcattctgcacaaaaatactacaaatgtgaagaatgtggtaaagcctttaagtggtcctcatcccttaatgaacataagagaattcatgctggagagaaacccttctcatgcgaagaatgtggcaatgtctttaccacatcctcagactttgctaaacataagagaattcatacaggagagaaaccctacaaatgtgaagaatgtggaaaatcctttaataggtccacaactcttacgacacataagagaatccatactggagagaaaccctacacatgtgaagaatgtggaaaagcctttaattggtcctcaacccttaatgtacacaagagaattcactctggaaaaaatccctacaaatgtgaagattgtggcaaagcctttaaagtgtttgcaaacctgcataatcataagaaaattcatactggagagaaaccctacatatgtaaacaatgtggcaaagcctttaaacagtcctcacacttgaataaacataagaaaattcacactgtagataaaccctacaaatgtaaagaatgcgggaaagcttttaagcagtactccaaccttcctcaacataagagaactcatactggaggaaaattttagaaatgtgaagaatgtgggagcctttaagtcttcctcagtcttttctaatcataattcatactggagagaaactctacacatgaaaaaattgacaaagcttttaaccgcaactcaatctgttctaaacataagagaaatggtattggtgagaagccataaaaatatgaaaaatgtggaaaagccttcaaatgcttgtcacatcttactgaatataattcttactgcagaaaacccctaggaatattaaaagtgtggcaaaaccttt

SEQ ID NO: 6779 - DNA, 622 bp, Homo sapiens
cggtgcaggccctgaggggcgccgagatgtgggagctgctggccgcggcgtgggcagttcaggggctgggcggctgaggtgtcttcaaaaacaaacatatttaaaagattttacttctcatctccaggaagaaccagctaggagtagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacaggacagcactaattggctgtggcagctg

SEQ ID NO: 6780 - DNA, 619 bp, Homo sapiens
actcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcaggatcttgctccatcacccaggctggagtgcgtggtacaatcatggctcactgcagccttgatctcccaggctcaactgatcttccttcctcagcctcctgaatagctgggaccacagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgct

SEQ ID NO: 6781 - DNA, 671 bp, Homo sapiens
ctgcccctccctcctggctccagagtctggggggcccagccacccgacaccttgctcccctctccttcagtcccccagcactgtcccgaggcacctagaggcccagagacatggggtgcttccctcctgtccacaggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagacca

SEQ ID NO: 6782 - DNA, 4056 bp, Homo sapiens
ttaataaccagcgcagcaggccccttcacctgcttttatgcctggaccagatgactgaatgtagaactttaggcacttttttttttttttgagacggagtctcggtttgttgcccaggctggagtgcagtggcgcaatctcggctcactgcaagctctgccccccgggttcacgccattctcttgcctcagcctcccaagtagctgggactacagactcccaccaccatgcccggctaatttttatattttttagtagagacagggtttcaccgtgttagccaggatggtctcaatctcctgacctggtgatccacctgccttggcctcccaaagtgctgggattacaggtgtgagccaccagatcggccctttaggcactttctacttctcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagccattaccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtctat

SEQ ID NO: 6783 - DNA, 668 bp, Homo sapiens
aatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacaggttagactcaattttcccctcttgggacgatcagtgtgtttattatttatagtaagggctttgttctttatagatggaaaggcctagagcttctatttaagtagttgtgctagttattagtatgctttaaaaatgataagtactattttcctggttatattactgattatataatagtaaaaggtaataactccagcttgatctctttaaataatgccttcagatgctaaaatctgtaaacaacttttcaggcttatgttagactcctat

SEQ ID NO: 6784 - DNA, 2246 bp, Homo sapiens
gggaagcaagccatcgtgtggcagaggcccaggtggcaaggaaccaagggcggcttctggccaacagccagcgaggacctgagaccgtagcccaacacccctccaggaactgaattttgccagcaaccagtgagtgaccttggaagtggatccttcccccgaaagcccggctttcagacggaggctggtgggacctcaaccccagctggtatccaggctcttgacaccatctggagaaggaattcaagagtgtgtcagaaaatgatgaaagtacaaagatttattgcaaagcgaaaaatacacactcaagaaaggggagtatgggtggactcaagacagagtccgatgggacttggggtttctaccttttgggtttcttttttttttttttttgatatggagtctcgcactgttgcccaggctggagcgcagtggcgtgattttggctcactgcaacctctgcctcccgggttaaaacgattctcctgcctcagcgtcccaagtagctgggattacaggctcccaccaccatgcccggctaatttttgtatttttagtagagacgaggcctcaccatattggccaggctgttctcgaactccggaccttaggtgatctgcctgcctcagcctcccaaagtgctgggattacaggcgtgagccaccatgcccaatgggtgtgggatttagtatattaatgagtgtataatgaggtccttggtgaaacctacatcaaatccagcaccgtgttgggtccagtctgtcttagccagcttggtccacaccctggttttttagggtcttattggccccttacttctgcagcaaaagtttccttttgctagtcatgtgaaactgccacctggaattttctattctctagtgaccaccctgtattattcctgtctcactgggaccctaagaaattgggaattccaactacacatccaaaatagtttgactaaaactgttgaaaaaagaaaaaaataatggcataaagtattgcttgactaaattccagccaggtgcattggccactttaggtcgggtgtggtggctcatgcttgtaatcccagcattttgggaggctgaggcgggaggatcacttgaggtcaggagttccaaaccagtctggccaaaatggtaaaaccccctctctactaaaaatacaaaaattagccggacctggtggcggaagcctgtaatcccagctactctggaggctgaggcacgaaaattgcttgaacccaggaggtggaggttgcattgaaccaagatcataccactgcactctagcctgtgtgacagagaaagattccgtctcaagaaacaaaaacaaaaatgaaaaacaaacaaaaagaaagcccattctatcttttttattttttatttttttgagacagggtctcgctctgtcactcaggctggagtgccacagcgcgatctctgctcactacaacctccatctcccaggctcaagcactcctcccacctcagcctcctgagtagctgggaccacaggcacagaaaccccactgtaaataaagagaggtaggcttttaaaaatgtcactctgttcacagtaaggcaagcaagggaagcaaaatcaatttctttctagaggtgggataatgggtagggagtggaagactttaggaaagaggtgccccagtttctgagtcacttcatggcttcaatattcattgactatcaatcaacagatgaatggatatacaaaaggtggtatctctgttgcagcaggtagttagtcagagctgagcagggaaggagaggctcctccgccccatcaggagatgatcaggcagttgttaaactgtctctctcaaataatcattggttgcagccgatgccagggaaagacagtctcccagtagatagaaacgccagaaactggtgatcagcagcttcccagtaagatctcaggaggtgggtgagtgggcttaagcatgtgcatgaagaggcaaaatggttgagcttagctggtacatgaccttcctctaggaacactcaactgataagggaagaacacctcaagtgagcacacatatagcttcagtaaacacactcacatgcagcccctcccaagtgctggcaggccattgtacatgcagactgccaacatataaaaccacaagtcaaaggtcaaaccatgcacttgaatctctcaaggtccctactggccctcttccacgtgtactttatttccttgcattcctgttctaaaac

SEQ ID NO: 6785 - DNA, 3685 bp, Homo sapiens
tatttataattctttcagtcagatttcctggagaacaatagttgttaggtgcctaccagaaaataggactagaaagtcatgttggagccatattgtggaagtccaaggaagtcggatgggagcaaaggtcatttcaattatatatcaagcttatattctatggaaactaaccccttcctagcacatatattattgaaaaattattcacctgctattttatcaatgtcatttataaattaaaatttttcttattataactataccttaaaaacaccaataaaattgccagatcactgatattcctgcttttattattataagataatatatcagttcttcaaatacacctttgagtagaaggatggaactgaaaattgatttgggtttatttaaaagagaaacctttcaacaatcctaaatctcagatttttaatagcatttttgttgtttgagtatggccagtttcctatttatttcctatttcttattgtttgacagtgcccatttatgtaggaaaatcaaaatggaaaagtacattagaaaacgtataaatccttcaacttaaagatgtatgatattggtatctggttgcataagtttctagtcagaggcttttctagtcatttctgttcaaaagtgggatccaccagaatgtacacgtgatgatggaccttgtctgtctgttccccagtttattgttactatgagaataatgcctagcagagagcaggcagtctgtaaatacttgttgagtgtatacatgaataagtccttttgtactactgttttgtaacgtactgtaacttttattttatttttttgagatagggtctcattttgtcacccaggctggaatgcagtagcgtgatctcagctcactgcagccttgacctcctgtgctcaagccatcctcccaccttagcccccaaattagctgggactacaggcatgcgccaccacacctggctaattattattattattattcttgtttgtattttttgtagaggtgaggtttcgccatattgctcagggtggtcttgaactcctgagctcaagcaatccacatgcctcagcctcccaaagtgctagggattacaggcataagccaccacacctggccgctgtaatttttaaaatagacaatttgtcagatatataggttgggataaacgaaaatgtgacaaaaggagcgtccctctgccaatttagaaatataaatatgcataaaaatacttaaagatacacgaagctttgggaaattgccatacacacactctatccccagtataccagtattttacagattttaaaaccagtaacaaatatttatttacaataccattctgcctaaaatttacctattagccagattgctttatgcatttggtcaaattgcatttagtcaaattgttttcagccaaaccttatgcgcacatgctagccagtgggatgataagagacaagagatgtagtctgtcttcttgaggtattctcatatttccgggcacataaatacagtattgaatgaaaacttacaggatgctccagggtcacaaaggagggacatctaagttaacctgggattgggatggcccaatgagtcttctcaaaagaagtgcttgaaatgaccagttggagggcaggagctgtgttttatttgactttatatttactgctttgtagataatctatactaaataattattggatgaaataatcattgaaatctgaaataattattcatgtagtaatttattggatgaataaatgaaatcaagttgaagatgcatgggaacatatttaaactgttgtatcttgggatttaagctggatgaaaaaataagtcaaaggaagcatttatgtggggagaaatggaagctacatatctctttaaaatcaaagattattcctaatggaaaataaggaaaagagaaaatttgaattctgggagacttaggtttctgagaagttctttcagataatgacaattcaagagtggttctttgaggtaggagatggctgaagtggggcaaaaataatagttatttaatgatattaataagttatgaggttagaatgttgaggacaggttatatagaggacattgaaactgccaaagatatggtaactcagatatgttagttggtcttaactcaaaaggtaaaaagacagtcataatcttatattcctgtaatttgcaccagatttaaaatatagaatactgagctcaaagactcagaaatggtttattttgattagatgcttcccaaatggcattaatatttaaagagaaaaaaacaaaaagaaaagaaaaataaaatcccaacaaaacttaggtttttcaagacacaagactattgcggctaaaactgtacaaaaaagataaaaaaaaattttctacacttttattggaaagatgaattgcatgtgcaggtggcaagatgaattgtgtgtgcaggtgacctagcccaggtagtggtcttagtgtgaatgcttatgctaaatatgtccctagaaataaaaacatctagacttcttaaatatactggattaaaatgatcctgaattaattcatctaaacattaagataactggcttttctacttcaaacacaattttgcatagaagatctttcaatactgaagcaaagaagtggccttgggactctctaagggtagaaatctgggataaaaatgtgtgtgtgagtgtgtgtgtgtgtgtgtgtgtgtgtgtgtgtgtggtcagaatgtggagttcaagccactgcatctgcagtgcggaagaaaggaagtgagttgggttgggaatgcacctaatcccctccagtattaaaaggtggaaaaatgccagtgaaaattcaaggttcaagattattgcaaaggtgggtagggttattaaatcacatatttaaataacagtgcagtgcagagccatattggagcctgaagcaaaggaaaaatttgtgttatttaacattttgatgttcattttgtacatcacagattttacattaattttgatttttataaatattgtgttaaaatattatttcttttgattagtgagttttagtgcctccttaaagtttgcacctgagaccaatgcctcactcatctcaccatagtcctcagcagatcaagaaggctttcaggttccctgacctccatctccaagaccattaggcagaaaggcctgtaaattgaaccacatggggtttcaggcaagggaggcttcattgctgaaatgatagtgctcaatggatgaataaaatgaagccatgttattgctggccccaaacatggttaaatgaactatctgtatgataaaaggacctggaaatcactggaatgtgggctgttgctacatgcccaagacattgaaaaataggttattgattttggtcacatccagtcaaaacatatctaaatgtggtagaatcatgaaattaaattgaattatactccatatatggtggttttgtttatatgatggaacttaggctgttttgaaaatacagatctagaacatgtttcacctatacttttgggataaagttttttggaaaccttcttgatcactcttgatattatttgggatacattttctgatgtttaaattttgtttttaagatgtcagatggattaatctctaaagttccttgtaagaagctaggatctgttac

SEQ ID NO: 6786 - DNA, 348 bp, Homo sapiens
aaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattggtgagctcaaaggaaggacagagagacttggggagataaaacttcttttctcttgcag

SEQ ID NO: 6787 - DNA, 1005 bp, Homo sapiens
cgggcgccccctcacggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacgtgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgatattctagtttactctggtata

SEQ ID NO: 6788 - DNA, 2247 bp, Homo sapiens
agctttctaaaatctctttaggggtgtgcgtaggctcctgtgtctatgcctgcttttgactgcccagttgaagcctcttcctatgccttttaaaatttcacgcactataaggaggaagagctcagggctcccaaaactttttatttagagggaagaatgctagggagatgggtatgcagagggttgaccaaattggaagaaaatatttattctgtagtttggtgttggaaaagggaattttccaatcagccacacctcagtgttgcggcaaaataattcttggctcccctggaaacgcatgggcaaggtagggcagagctgctgctgctgatactgccaccaccctgggcttcctgctgactctgggctactccctggggacaacagatttgcattgacgtccggggctgtccagaggccctcaagagccagttgtgagctgagcccagtatgggaaagatctaccttctggaagctactactacgtggtgcttggaaagatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggagccctgaaatcagcattcccagaggaaagaagatggccatctgggcttggcttccggctccccccatctggctggaacacacatcagtcacccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagttt

SEQ ID NO: 6789 - DNA, 1330 bp, Homo sapiens
ccccatgcctccagactctatgtctacacagctcaccttggccatctcggggccagagggcagaagcagcttatgttgggaaggggcatctgagaagaaggagcaggtctgcttgtcaagagtccaagcacgcctgtgttctgtggccacaggagaggaggggccgcttttaaatacaagcctactcctgtcgttggaccagaacaaagacctactggccagaagcacatgagaggtgagagtcgcccttctgccttgttcggcatcgtgtgtgtgcacctgtgtgtgtgtgtctgtgcaactgtgcatgtgtgcacatgtgtagcacacctgtgcacgtacatgtgcctgtgtcggtgtccatgtatatggcttgcatgtgtgtgcttgtgcacacgcaggagtgtatgtgtgtgccatgtgagtgcctgtgtacatgtgcaagagtgggctcaggtgtatccacatgttcatggtatacctcggccggtcctagacctagtatcagactctgctgctcctcactggcataaaggcagaccctgaactgggcatggggacacagatgggtaacacgcaaaccacagggccctgatccgggggatgctggccaagccacgggcagtgcaatgcagtatggcaaaggaaggtttcctgtccacagtgcccctcaaggcagggccccccaggagcccactggccaggcccagaggtggggttagctctgcagtgtgaactcataggttctggtctcccagtgggagaggtccttgtccatcatgctacgctcagtgaaggtcacgtggccgtccgcatctaccaggatgatagtgttggttctgaaagagagcaggggccctcgttcacctggtgtccctcagccctgccctgcctgtcacagccacaaatagggcaagaatgcaggcaggtagagttaggaaccccatgcctggaggctgtgccaagtcacagagagcagcagcctcagtcttggggatgatgaggggccatcagtggcgtgtgagctcttggctggctccacaggcccacacttgctgagtcctgccaccttcactgggaaccaccccaccctgccctgctctccccgtgtagcatgagccaaggcatagggcagcctgcgggctgaccacacacttcccctttggaggcccaggttcccagacacagccatgcttggttcttccaagaggtcaagctgttgaccacttggggcccaggcctcctctgtctggaaggcttccctcctgtgccctctcttccactgcccaggccatgccagcccacctgaagcaaacattcagcacactct

SEQ ID NO: 6790 - DNA, 2814 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttg

SEQ ID NO: 6791 - DNA, 1693 bp, Homo sapiens
cggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccgtaagcgtggacccgggacacccgccggccagcgcactcgcggcccctgcgtttctgcgccgcgacccagctagtgtgcagccgcccggccaccctcagccccttcctttcataccttgcttcgaaactccgacaaattatgtcgccccgcaggcaaactgtgggacatccgttctcccgccccgccgccacccccactgtcaccccctgctccagcccctcgcccgggccactgcagagccgccttgacactctccctgcgtcgccagccaccgccctagtcgctgctgctctcatccctccggtggcttcccttccctttggcagctgaagtcaacccagccccttgccaaccctccagggctactatctgctgccgtggtgctcctcgaagagaccacgcctgctgccaagctctgcccacccggaaccccccgcatttctgggaggctggcgcctccactctgtccacgtgccgcctcattactgcgcctcaccactcccgtctcagcctcatgaacctagcatctaacgtaccccggtttttttttcttaccccgagacggagtctcgcgctgtcacccaggctggagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttaattttgaaacagggtcttgatttcgcttaggccagagtgatggcaccatcatagctcactgattttgctatttacttttagaaaaatattctttagatcaattagaggctttgctgggacataacatccagaagtcatttttaagtatcttcatgttttcttatttcagctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacactc

SEQ ID NO: 6792 - DNA, 1404 bp, Homo sapiens
cacacctccgacttccgcacggatgactcccagcccccaacgctgggccaggagatcctggaggatatctccagcccagcagagatggccctctgcagtctagccgtattttgcccttccaccattcttggctgtgacctggtccagctgggccctgaatgaatgtttgcttctcaggccagtattctcccctcctcaccaagccacctccacacagctctaaggaagctcccccaggtccaggcctcaggggagccctgccctcaggccgaccctactgccttttcagagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 6793 - DNA, 216 bp, Homo sapiens
acttttgtttcatccaacctcacaatagaaaaaatatctgcactagaaaacagtaagaattctgacctagagaagagggagggaagaatagatgatttattaagagccaactgtgatttgagacggcagattgatgaacagcaaaagatgctagagaaatacaaggaacaattaaatagatgtgtgacaatgagcaagaaactccttatagaaaag

SEQ ID NO: 6794 - DNA, 1326 bp, Homo sapiens
aagagtgaacacacactttgtgccggctttaaagaacccagcacaaagccagtctgcatggcctacagacatattttgctggacaatgattacttgcttttctttttgtttttcttgtatatgcctgtttgattggttcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacattactgtgtttgtagggggaggtctgatttacagagtaaccacatagtaattataattattagaatgtccagttttcaaaaaacgttacaaggcatacaaagaatgggaaagtgtggctcattcaaaggaacaaaataaagtgacagaaaatatccctaaggaaacccagacatcaaacttaccagacaaagactttaaaacaactctcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttcttttcacctttcttccttcttccttccccctcctcctttttacttttcttcctcttcctttctcttcttctttctcgccttcattatccctttcgctgtttctctttctccctttctcttttttcttttctttcaattttctcaattactaagagatgtttaagtacccttagcatgttagtagatatggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaaattgtgtagctttttccaatggaatgtttattctgaattatctaattcatattgtaagtatagagggagtttaatataaaattattaaactaatatttgt

SEQ ID NO: 6795 - DNA, 882 bp, Homo sapiens
ggcgctgcgagatcgctcctgaagcaggaacccaaaacaggatttaagtcacaatgtggaggtcacagctcgtgggtgggggggcgaaaatgtagggaaaagggtatgaaagaccgaatgcccggctcttactgttggttggcgtgctggagtccagaaccaaggctggttaagatggaaagtgtctgatgaaagagaatgatgcgctgggagctttgtcttcctgacaaatttgttctgttcttcaggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccg

SEQ ID NO: 6796 - DNA, 232 bp, Homo sapiens
gttgagcttgaacgctttcttaattggtggctgcttttagctgttcttaggtagctcgtctggtttcgggggtcttagctttggttctctttgcaaagttatttctagttaattcattatgcagaaggtacaggggttagtccttgctatattatgcttggttataatttttcatctttcccttgcggtactatatctattgcgccggtttacaatttctatcgcctatact

SEQ ID NO: 6797 - DNA, 596 bp, Homo sapiens
aattgctccacctctggtgccagttagtggaagggtagaaagatgggaaaaaacaggtctgggtttggatgcactcttttgcagcatgagctctaccgaatggagaggaagtctcccttcccttagagttttggctcctgcagtctcctgttggtagccactgtaacagctgccaccattactgtgggatattttggagtctgaggcataagagaatggacaaaaaggagaggaaaagacccagaggattcctgcattctctctaagctttgggagttcctcttcctgcagtttcagccacaactagaagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgata

SEQ ID NO: 6798 - DNA, 849 bp, Homo sapiens
ccctgtcttccctctggagctgtttgaggaatgcagttcttttgcataagaaaggcttttctctccagtcattctgcttgctgatcaagaacacttaacagcttcaggctttcctgatactttgacgaaggtaattgggactcccatcaagtctccacacagctagcagccacgtggggcacttctccagcatatgtaagtggaactcagaaggcaacattccctgaacatactcttccaccagaatctcctctacagatttttgctgccccttttaccagtggctgaatctactttctcttatggtttggtttgcggcagaagaatctgcatttcgaacaagtgccaggactggtctgaggaacacacgttgagagaggatcagatctgacccagaatcaacagaactgaagctgcaaattcagctttgtgaaggcttcagatgtagccatggttaaagaagattgacattaagcagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattgg

SEQ ID NO: 6799 - DNA, 570 bp, Homo sapiens
taaatgtttgtcaagctgtactgctgaggggataccaggtgtaactagatttttccctttaagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaaca

SEQ ID NO: 6800 - DNA, 2863 bp, Homo sapiens
agggaggggcacagggggctgaggagtgctgggtcgggcttccagctccctacaacgcagaccagtactggagttcgtggtgctggaagaccgccgcccgactctgggccccgggtaggaaacgtaagtgccaggaagttagcagagtggttctttggctggcgcctgaacctcgccagtcttcgtcgcccctcccctgccaacgcctaccccgcttcgaccggagggtgcgctgtccctctggtcactgtgatcaccgtccatggccgcctgcggatacccacgccgtgctcagaagagggctctgaggccacgcccgcctgtggggtcggtggccgggcttccgggaccccagagggagtcgtcgcgcgctaggtggaggggacccctctggaatccggcgatccccgggcgcagatgcaggagcgggtggggagagccgcgttcctggcatgtttgcctcgagttagtcacgaaggaatcgaagagagccttagtcttcgaggcttttcccttcctgtgagcccctttgaggccagcacattgatttttttttctttcgcagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaattccttaaaataaatctctttctgcatatacacatcctattgattctgtttctctggagaacccgtactaatatagtgtctgactagatatgaaggaggaggggaagggagaaatagatagacgatgcctttggatattgagtgacacttatctagttgcttaagtcaaaaacctgaaaactggttaggcacgcctattacgggctcacgcctgtaatcccagcacttagggaggctgaggcaggcagatcatttgaagtaattcaagaccagcctggccaacatgatgaaaccccaagaccactaaaaatacaaaaattagccgggcgtggtggcacatgcctgtaaccccagctcctcaggaggctaaagcaggaaaattgcttgaacccaggaaacagaggttgcagtgagccgagattgtgctactccactccagcctgggagagactccatctgaaaacaaacaacaaaaaaaaatgctgggcacagtggctcacgcctgtaatcccagcactttaggaggctgaggcgggcggatcacctgaggtcaggagttcaagaccagcctggccaatgtggcaaaccccatctctactaaaaataaaaaaaaaattagctgggcatgttggcgggcaccgtaataccagctactcgggaagatgaggcaggagaatcacttgaaccgggaggcagaagttgcagtgagctaagatcgcgccattgcactttagcctgggcgacgagcgaaactccctctcaaaaaaaaagaagaaggctgggcgcggtggctcatgcctgtaatcccagcactttgggaggccgaggtgggtggatcacttgaggtcagtagttcgagactagcctggacatggtgaaacctgtctctactaaaaatacaaaaattagccaggtatagtggctcatgcctataattccagctacttgggaggttgaggcaggacaatggtttgaacccaggaggcagaggttgtagtgagctgagattgtgccactgcactccagcctggatgacactctatc

SEQ ID NO: 6801 - DNA, 3408 bp, Homo sapiens
cagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtct

SEQ ID NO: 6802 - DNA, 6273 bp, Homo sapiens
gggtttcaacttcattctttttcatgtactgaaaatacttttttattttcagtaagaaacttacctaactgcctaccatcccccatgctcagtagccttgatgatggtggcccatatttgtggtgtagcttgctggtgccaggagggacatggaccttgttctcaaaaaattgtggttatgttttgttgttgttgttgttgttgttgttgttgttgttgttgtttttatctctggcattccctgagaggctggcacagagactagcctttgtttcacctcccatcaggctgaagtggcttcctaagtggagtctattgaaaagatttaaaaacatactacccatagccacctgaggcaagggagagcagacaagacaagcagcaaacaaaagcctgggaaggaggaagctgatgaagaagataatttgtgaaataagggttttgctgggcccacgtgtactgaggaatccaccaaaagtatgctcagaaaagactttagagcaggggtccctaacccccaggccatggactggtactgatccatggcctgttaggaactgggccacacagcaggaggtgagcagtgggcaagcgagcattaccacctgagcttcgcctcctgtcagatcagcagtggcattagattcttacagaagtatgaagcctattgtgagttgcacatatgagggatctaggttccatgcttcttatgagaatctaatgcctgatgatctgaggtggaacagtttcatcctgaaaccatccccccatcacccttccccatccgtggaaaaattgccttccacaaaaccagtccctggtgccaaaaaggctggggaccaccgtcttagagggccctaggcttggacctctggatgttctttgggctccatgcaagtaggagttgggctaagacagaattgtaggcagcctagctaattgaatgattacgcagctcagagtcaatctgcaaagactgggagagtttgtcttgttttgttttgaccccaggcatttaaggaaatctctgtcaggtcactggctaactgctgaggtaacaaagagacttcagtgaccacataccgtaaacaaaatttactcaaacaaatcagtgatctaaatatagctactaaaactacaaaactcatagaagaaaacatagcgataaatctttatgaccttagatttaagttcatcctctatggcagtggattattagatatgacacctaaagcatcaatgataaataaaaaataggttaattgaacttcatcaaaattaataacttttgttcatctcaggacctaatcaaaaaactgaaaagacaacctatagtatgggagaacattcttgcaaattatatatctgataatggtctactatccagagtatatataaagaactcttataactcaacagcaaaaggataaataacttttaaatggacaaaggacttgaatagctatttcttcaaagaagatgtacaaatggccagcaagtacgtgaaaagatgcttggtgtcattagtaattacggaaatcaaaaccacaatgagataccacttcatacccactgggatggttgtgatcaaaagaacaaaaataacaggttttgatgaggatgtacaaaaattggaacccttatacattgcttgcataaatacaaattggtggtacagctgctgtggaatgcagtttggcagttcctcaaaaagttaacataaaggccgggcacggtggctcacacctgtaatcccagcactttgggagtccgaggcgggtgaatcacttgaggtcaggaattgaagagcagcctggccaacgtgatgcaaccccatctctaccaaaaatacaaaaattagccaggcatggtggcgggcgcctgtaatcgcagctatgtgggagaccgaggcaggagaattgcttgaaccctggaggtggaggttgcagtgagctgagatcacatactgcagtccagcctaggcaacggagcaagacgtcatctcaaggaaaaaaaaaaaaaggaaaaagataaagttaacacaaaattgtcatataacccacctattctattcccaggtatatacccaaaagaagtcaaagcaaatatttaaatagttatacatgaatgttcatagcagcactattcacagtagccaaaaggtgaaaacaacccaaatatccattaataaatggataaacaacatgatatatcatacaatggaatattatccaatcataaatattacattcctattccactccttgcccataatacctcattctgccatgcgattccctaactgttctgggaagggacagtgcgtgtctttttggacactgaacattatttacctggcctgttcttgtcacataccaggcacttaaatatttaaacattgaatgccatactctttgcagtgttatttgtaataggaaaaatttagcaggaaggaggttattggggaggaagatgtaaacttacaatactctagaatggttaaattaggaagcatactaaatgaatgcctcatatcattattataaagaccatatagaaaaattaatttacattataattgcaattatattaaaatgatggaaaataaaattaacagtttgattgcatgacttaggaataatgtacttcttttagctagatatctattgatattttaatgtttctgcagttgttttagaaagataaaatgattaggattttagtggagatgagctctattttttccctggagtaaaatgtgcatattcattcagataattcattcaaaaatatttcatggataagattgctgtagagtattgaaatagagtaagtagtgtgatcaaaagcgtaagtgggagagatggacagagaaagggaagatgttggtcaaaaggtacaaagtttcagttaaagagtattaggttctagctacgtattacacagcacagtaactagttaataatgtatatttcaaagtagcaattataaaagaaaatgcattttaaatgttaccacaaagaaatgataagtatctgaggtgatggatatgttgattagcctgatttggtcattccacagtgtacatgtattgaaacatcacattataccccataaatatatacaattattatttgtcaattagaaacaagttaattttttaaataaaattaggttattaaaggcacagtaaaagcataggggaatagtttacatagactagatttattagagaaagtaattgcagggatggaacagatgtaaaacttaatcgggcctggattatgtgactaccttgagctaccaaaccaatgaatttaggttttatcggatagtgaggagtgctgactgccttaaaacctaatgctttaggaaagttagtctggagacttttttcagggtgaattggcaagtgagcagcctcagagtcagagaagtgcagctttccagactaagtaagaacctgatatagagggctaacagtgagggcgcagtaggggaagtgaagggagagaagggcattgtctatgcttgaaaaggttaaaaagttaactttgatctgcacttttctctccttagtatgctcgagatttcatctttcagctgcatcttctgaccctgttaaaaagggagtactaacagtggacttctctggagtactaacagtggacttctctccgtagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaa

SEQ ID NO: 6803 - DNA, 1609 bp, Homo sapiens
atggaggacgagcagcccgacagcctggagggctgggcgccgctccgggagggcctcttcgccgatccccaggggcaccggttgcgcttcctggtggcttggaacggcgcggagggcaagtttgctgtgacttgtcacgaccgcaccgcgcagcagccgcagcggcgcgaggggcccggctggggctggagcacaagcccgaggccgccgtgtccccgcccagctgggccggccggctctcggccgcggggttccgcggcgcgcgccggcagctagcggcgctgtggccgcctctggaacactgcttcccacggctgccgccggagctggacgtgggcggcggcggggcctgaggtctggggctcgggcggtgggcgctgctgtggccggcgcgcgtgggccccggcgaggcggcactgcaggagctttgcgggcagctggagcgctacctgggcgcggcggcccacggctgtggctgcgccaccgtgcgcgacgctctcttcgcggctaacggccgcgcggccgactgcgagagcccgcgcgagtttcgggagcgggccctgcgcgcctgatgggtcgaggcggacgcgcggctgcgtcaggttattcaaggacaccgaaaagccaacaccatggtagcattaatgaaagtttaccaagaggaagatgaagcctaccaggaattagttaccgtggcaaccacgttcttccagtacttactgcagccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagagttatgtttaaatcacaaaagagctgaaattcagggaaagatggaagatcttccagaacaagaaaaaaatataaatgttgtagatgaattagcaatacaattttatgaaattcagttagaactatatgaagttaaatttgagatattaaaaaacaaagaaatactgcttactacacagttggactctcttgaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcgaagaaaatcattggctcagattgcaacaggctgaagaaagcataagatattctcgtcagcatcacagtattcagatgaaaagagacaagataaaaaggagcaaaagaaaaaagaatggatcaaccaagaacgtcaaacactccaacaattgagagcatttaaagat

SEQ ID NO: 6804 - DNA, 2828 bp, Homo sapiens
gttgtgattggtgggtatttgttgtgattgattggtgggtatttgttgtgattgcttggtgggtatttgttgtgattggtgggtatttgttgtgattggtgggtatttgttgtgattgattggtgggtatttgttgtgattgcttggtgggtatttgttgtgattggtgggtatttgtttgattggtgggtattgtgattggtgggtatttgtttgattggtgtgtattgtgattggtgggtatttgttatgattgattggtgggtatttgttgtgattggtgggtatttgttgtgattggtgggtatttgttgtgattgattggtgggtatttgttgtgattggtgggtatttgttgtgattgattggtgggtatttgttgtgattggtgggtttcatgtgctggtctgtgtacttgttccttcagtgttgattttgggttctaaccttacaacctttttctctttcatttttagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctc

SEQ ID NO: 6805 - DNA, 2658 bp, Homo sapiens
acgtggagccggaagcccactcttgcaactacaacagtcttggtaaaccttgggtggactggggagaactgaggaggggaagcgcttttttgttgcttctctgtgttttctattttattttatttattttatttttagattttcagttcttatttcacccagggaaggagacctgggtatccaccccatgtcctccagagaacttccctggccccgctcggagtcttcctgggacgccacaggctcggagagcgctccgcaggtttctcccccggcgcctccaaatctttcgattcctactcgaattactccgtcagctgctggaagaggggcaaggggtatggcgagacgcgttggtacatggggcactggggggaagggaaagcctccctccttctcctagtaattcgagaatgttgcgtccgcctcctttcttttgctggcgctaggggctcggaccagcacctgccaggcataggtgtggccactggggcgaaacctggcaggctctggaaacagcgttttactgacaggaaagagaaactgttctttgtattcatcacccaccgcagacttcctcacgcccgggtcttaggcggggctgtcagatttcagtgtgtttctcttaattctagtactaaatttgtactgggcgctggcgaagggcctggctccgccacgcgcggccctctcgaactgcccgtgggtacggcgcgcgctgctgccctgtgtggcctgtgcggggaacccgagggccgaagtgggccccgccgcagcacagggggacaagagaaccaggagcgggctgcctgggggcagattcgaacccgtgctcccagcggatagaagtagcacttggggactcctaaaatattcagcccaatcctgattccagctgccctctctaggcacctttcctctacccttcttccagtttacaattctggtgagtagatgtttctctatctcttctcttccaactcctgcgcccagagccaggaggacttctggagcccgcccagcaagaccctctctctcccatcttctgctcaagggctcgaggtctcagtggacagagctgaagaaaagccgtctatggagcctgcgccaggcgcagactgggtcgtcgcagtctgggtcgtcgcagtctgggccggggcgctggaagtcttactcacttctcaagaacccgcaagggatcaggcctgaccctttgcaagtgacagaatccaaagctttgagctcatgggaaagtggctggaaagaaggtcactgtagggccgcacaggtctctggcgaggctacccaagaacatttaaatccctgcccagagaagaagaggctccagctgtcctgcaccttcctgggaactggcagtccctccgcgcaggggttctgcagcgaccggcagcgcgaggagacaaggatggtggccagttaacagaaaatcaaggcagcgggaaagggaggaatggcctacaggggccatgcaggggctgcatggaggaattggtcagtacacacagaagtggatggcactgggccaggcacagtggctcacacctgtaatcccagcactttgggaagctgaggtgggtggatcgcctgagcccaggagttcgagaccagtcaagacaacatgacaaaactccacgtctactaaaaatacaaaaactagctgggcatggtggcatgtgcctgtaatcccagctacttgggaggctgaggcaggagaatcgcttgaggtggaggttgcagtgagccaagatagtgcccctacactccagcctgggtgacagagtgagactttgtctcaaataaataaataaataagaagtggactgctgtggtgtgagaatgcacctgacagacctccaattatggagagcttacacagccaagggccccaactgctgctctctgaaactcatcctgcttttgtgctgaggccacacttcccacaggctgctccagccagtgaccaagcacagcatggacactaagacaggcccattctgggagacgtgggactcctctgatggccaactttgacttggggactccctgatggccttgccaaacctttttgataaagcactttggtctaggaagcttctacccgaccttccttcctctctccttcactcagggtcagacttataatgtgatctgacagttcccccagcatttcctggctctttctcctttcctttcacaggtgtttctcctgagaaaattcttgcatgtttaaacccaatttgagggattattgggaaaattattgggaccactattggaacagttgacaaactgtcactgggggtgtgtagattaaatgtcagtatcgtataaatccatgttaatttcctggtagtgatgacagcactgtgattatataggagtgtgtccttggtgtttgggaattacatggtgaaatgtttaggataatggggcaacttactttcaaacggttccccaaaaattctagatagatagatagatagatagacagacaggcaggcagagtgagaaagaaagtgagaatggtaaaacaaatatatataatgttttgtggggagaatgaataggagttttttgtagtattcttacgacttttccataagtttgaaattatcaaaaataaaaaatgtttaaaac

SEQ ID NO: 6806 - DNA, 4487 bp, Homo sapiens
gtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacagtaagggccggggtcaggcaggacccagcacatcaccccctacttcatgccccagctcacattttcttaaagcaatgtctctgccacctagtttcctctgtgcctttttccagcctgacatttaagctcccccctcccacagggacagctcagtgtctgctccccagagtctggtaggagtggctggcatgagacctgaaaggggaaggaagcagggcaggtaactcatgtgagctgagcctcctgcgtgccaggcattggtgggtgtcatctccatgagttctcacagccgtcctatgaggcaggttctatcacccctattttacaggcaaggaaactgaggctgagagaggtgaagtaacttgctcaaggccacgcagagctggaatatgaatccaggtctgcctttttattgattcattcgaaaagtaattcagtgaatggtgacagtgtccggcactcgctgggtgctggggaaactggaggacaagcaggcactgtctttgcccagaggggcagggaagaccaacacctaccaggcacacacacagacacagttacagcttgtgaagagtattccgagggaagaaacagggcaggtggagtgctagggaataatgtgcacttgctttagttctggtggttgtagaaggcctctccgagaaggtgacatttaggctaagccctggtgaataataatgtagtaatcattagctaacatttattgaacactttctatgtgtcaggcactggtaggcagtttacgtggatggtctcatttgatctgtgcaacaaccctgtgcggtaggtgttgtgatgacagccattttccagatgagaagaggccagctgtgtgaaaggctgagttgctgcctaaacctatagcccgtgtcccctgggtcccctgctgtgcctgctttcccccgccaagtgtcagagtgtcagtctctggacaatcctttgaacgtcctagcctgggaggggagcccatcccagagggagggtgaaatgatctggtctctttttgcagagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccggtaagttctgccccttcccacgtttgcaagctccgattcctggaacccctggcttgagcttgttgcttttccaagcctgtctcctgtgttgggagccctgcctccagcagccctgcgaggcggcctggagcctcggtgaccacaacaggcagcgcagtcttcttctaaccacctctcctcctcctcccttgtcccgatgccagatttctcctcctcatctttctccttcagtcctggggctggtgcttttcgctctgtttctacatctaccacctttgtccaaggacgccgcatcaccacacgcaggtgagagctccttctggggccatagaggggtgagaggtctgctggggagctgtgttcaaatagaaagttggctccttgagggcagggcccagtctgcgctctctactgcggtggccagaactgggaccagcgcctgcaggattctgtcactgctcgttgcctgaactgtgctgtctcccacagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgaga

SEQ ID NO: 6807 - DNA, 2959 bp, Homo sapiens
tttcgtgccccaccccgggcacacgaggcctccactgcggttgcgcagcctgccgaagagcgtgcggcttctactgcggctgcgcaagctcgacgcgcgcactcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaattgtctatagatacaaaaaggagccaacctctttttttttcttttagtgtgatgttccttgttctatcttcgaactctcaaaggtagcctttacacagatgttcaaactaattctaccagtgtcatatgtctaccaatctcattacttcccttgtatgtacttctagagcaaagagctcattacagtaagaatgatggtaaattttactgaggcaaacaaagatttctgaacgcgagcagtgtgtgtgaaatgcttatgcactagctgatagcataactctggtcaaagaaatttggtcacttaaatattataattgaatttagcccctaaagtagctgttcttaacctggaatctgaagaacagcctgttggtggggctcccagggaatttgtgaaccactgaaattatatacataatttcatgtctgtgtaccgtgtacatttatttttcttacttttttttgagatggagtttcgctctgttgcccagcctggagtgcagtggcaccacctcagctcactgcaagctccgcctcctgggttcacaccattctcctgcctcagcctcccgagtagctgggactacaggtgcccgccaccatgcccggctaattttttgtgtttttagtagagacggggtttcaccatgttagccaggatggtctcaatctcctgacctcgtgatccgcctgccttggcctcccaaagtgctggaattacaggtgtgagccaccgcgcccggccctgttttttcttttttctttctttttttttttttttttttgagactggagttttgctcttgttgcccaggctggagtgcaatggcacgatctcggcttactgcaacctccgcctcccgagttcaagctgttctcctgcctcagcctcccgagtaactgggattacaggcacctgccatcacgcccggctaaatttcttttgtatttggtggaggcgaggtttcaccatgttggtcaggctgatcttgaacgcccgacctcaggtaatccagccgccttggcctcccgaagtgctggggttacaggtgtgagccaccgctcccggctcatgtgtacatttatctaagggagaggtttgtagctttcatttgccttgctttctctgcgttttgccatcccatttctttttatcttctgcacattccagaatgatcttgattgaggatctttctatgaaaactagaagtattcccaagaatgctttaattttgttaaatatcagggcgtaggttataatattgtatcactctgggacggacagggttaggctttggagtagaaagaccctagcctcaatcctgcacttactctgccacttactgttctgaaccttgagaaaatgacttaatctctcagagattcagtttacactgaaactcagttttacacatctgaaaaaagaggactattaatatctgcaacagatttaaggactaacaaatatgaagtatataaagcacctatgttatctactttactggatacataagtgttcagtgaatgggaaccatttaaaagcttacaaaaagcaggaacagtaattgaagatatcagtctatagagtaaccactatgtttattcattatttgttactctaatacttgcataagaacgtatatgtgcattcatgcgtgtatacatattggccatcattaccttttgtctgttgtgtataatacagattcttgttcttctgtgtcatcaccaacatgtaatattgtcagaatttttattttttgtcagtttattggttttaaaactcttatcttgtgttcactttgcattccttgcaggttgaggatgttttgttttctggtcttagtctcattcttccttctttttcctgttggtcttgttcttttctttttgatttgtagggtatattaggatggtgcaaaagtaattgaggtttttgcatcgttgaaatttgtcatttgatactggaataccctcttaaaccttcttaaatgtggttatgttatacatcattttaatgggcatttctcactttgttttttttttttttgctaatgacttattacttgctgtttatatttattttagactatggaaatgatattagacaaaaagcaacttcaagtggttttcttatttgagttcaaaatgggtcataacgcagcagagataacttgaaacatgaacagcgcatttggcccaggaactactaacgaacatacagggcagctgtgattcaagaagttttgcaaagcagactagagccttgaatatgaggaacacagtggccagccattggatgcttcacttcttgaagcatcttgacagctttttgcaggtgaaatgcttccacaccagcaggatgcagaaaaatgctttccaagagtttgttgaatccagaagcatggatgtttatgctgcaggaataaacaaatttatttctcgttggcaaaaaagtgttgattgtaatggttcctattttgattaataaagatgtgtttgagcctagttataatgatttaaaattaatggtccaaaaatgca

SEQ ID NO: 6808 - DNA, 1830 bp, Homo sapiens
ttccaggctcaacgaggtgctgatggaagcagaagagcctgaagtcttgcaggactcactggatagatgttattcgactacttcaacttactttcaactacatgcctcattccagcagtacagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacattggacccaagttaggtgtgacacgttcacacgactatgtagcacatgccgggagtgatctgccagacattctaatttgaaccagatatctctgggtagctacaaagttcctcaggggtttcattttgcaggcatgtctctgagctgctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagatggacaaacagcattgagaggccttagccctgctcctttcaattccatcctgtaaagaacaggagtcaggagccgctggcaagagacagcatgtcacccgggactctgccggtgcagaatatgaacaatgccatgttcttgcagaaaacgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctcatttctttagttattttgaaccccaaatatttcctcatctttttgttgttgtcattgattgtggtgacatggacttatttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttaaaagtagaaatgtcctgtattccagtgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaacattctctgcctgagttttaatttttgtccaaagttattttaatctatacaattaaaaacttttgcctatcactctggactgttggattgttttttacattcagcgttataatcttttgttatgctgattggttttggt

SEQ ID NO: 6809 - DNA, 1121 bp, Homo sapiens
ctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttt

SEQ ID NO: 6810 - DNA, 409 bp, Homo sapiens
agtgcagtggcacgatctcggctcactgcaacctcgacctacagagttcaagtgattctcctgcctcagcctccccagtagctgggactacagggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctg

SEQ ID NO: 6811 - DNA, 864 bp, Homo sapiens
ggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatggtgcggccacaaggaggctgtgttcttccagtcacacagtgcgcgggccgaggtaagtggcgcgagggctttctaagtatctggggcttgtttggtcctttctgggggcggggatatcaatgtgggtgaccctgcgcttcttggaactctgccgggcccttacctattggtgaagttctcttgcctgttcttttggggtaaggcgctgctgggtccaaatccttcctaaccatgcatcatttctgccaggacgccatgcgcctttactacgtgtgcacagccccacactgcggccaccgctggaccgagtgacctcctctctcccccgagtgtaataaacaccagattccatgcgtg

SEQ ID NO: 6812 - DNA, 4103 bp, Homo sapiens
gacgcgcacgccgccctctgaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgtaagttttctgaagcctctccagccatgccaaactgaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccacaattttcatttccactaaaatatttatttaatggatatcttacagaaataaataaaaacagtttttgtctaatacagataggtttttttatatatatgtaatttgattttacaaaattgaagcatatcaaattgttttctctaaaacatagctcagaaaggaatagtagaaaacaaacacaaagaaatactgaaatagtctcatttttaaattataagcatgggccttctgaatctcagcatgacatgttattagtaaaagaatgtaagatatggagtcaggggacctgggctccactgtttacttgctacatgtcctaagaaagtttcaatatatctgaacttcagttctctacctttaaaacagtaaagatattaattatatcaacttcacaagattgttgggtaaattaaacacgtaaatgtacatgaaagctctttttaatatgtgaagagctataaaaataacagtttgatttaatttcatataaaagaatcaatggatacctccttttaactgaagaataagcaccaaaagcatgtgtgtgttttcttcagttgaattacatcactctataaacctagagtaagaaaatgcaccttaactaagcaccaaagcctctcggacaaatgggatctagggaatggttctatgagttttccaggcagctaactgggagctaataagtcctgagggtcaaagagggtcctttaaaactctgaaggctcaaagaaaaggaagccaaataagaacatttgtattacatcaaatggctaggatgtaacaagctactccttattcagcaatttcaaagtccattaattcctcacagaagaagaaacacttcgttattatcacttgcaacgatttgcttatgtgaacatggcattctcttgttcaaaaggtcaaagactcgtgcttaagggaggaacaactggagtgaaataacaactctaccatgaattcagatatcactggctaaaaagtctagttacacaagaacatgggaaagaaaaagaatccaagacatcagtataataatgattaaaaaaaaaaccctgccatatttccatgttataataaaacaaaatcataaaaactgcaatatttacagatacatcaatcttacaacatataaaaactttaacaataagaaaaattaagagtagggaaagcagataattttaaggtaatcattaatacattaaaaaatctatttggagttaactgtttacactaacaccactttacacataatagaaatatgaatattttcattgtttttgttttcagtagcaagatgcagaagaaacaaataactgtctaacattaacttattgtaaggagttgtattactgcaaaattactaggtgtaaagttatggtataagcctactcaaaaaatgggttaatataattcaccatctacttaaaatattactaacaagatattggtgaatcatgtgctaaagatactgaaggcccttccaaaactgagatctatgtttgttcaatataccaggtcatataaaactagactagtttactttcttattccaactgttttatgagtgatcttatcataagaaaagtacacattacctctcttaattcccttgcatcatcagatatagatactatttgggacaaaaaataaatgttttattaggagtgtaaaattaagaatctttatagatcttttggaaacagtatattgaaaaggactcaataagtactaagccactgtataaccagaacaataaacaaattcattcaactagg

SEQ ID NO: 6813 - DNA, 566 bp, Homo sapiens
aacctctgcctcccgggttcaagcaattatcccgcctcagcctcccaagtagctgggatttcaggcctttatcattcagatactttttctgtgcaacatacacagggctatacccccctccatttttgtttcaatcccaactggcttgtctctaataaaaatacgatctcttttggagctccttgtgtgtcaataataatcctatcaacttataatttaattttaatacatttaaattagaacttataatttaatacatttaaattagaatttttttctgcctcttaaaaagaaatccaccacagagacactccacagcatgcacacataaacctagacttagcaatttctgtgactacttcttgtgttgtgcctacatcaacactccagtgaccattcctggtccatacacttacgtattctcctttgattacatcgcatggtcactgccgaagtggaagagcattttagatgctaaaaatactctgccgactgcctctagcaaagcctttactttgagtcagctctcttccctgaggcaggaaaaggcctgtttctctacaagg

SEQ ID NO: 6814 - DNA, 581 bp, Homo sapiens
ttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcct

SEQ ID NO: 6815 - DNA, 458 bp, Homo sapiens
cctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaag

SEQ ID NO: 6816 - DNA, 386 bp, Homo sapiens
aggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagta

SEQ ID NO: 6817 - DNA, 5618 bp, Homo sapiens
ggcgcgctatgggctgcacgtgcgcttccgaggcgagcagcagctgcgccgggactacggcccgatcctgcgcagccgaggctgtgttagcgccaaggacttccagcagctgttagcagagcttgagcaggaggtggagcggcggcagcggctggggcaggagtcagcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcgggtgaggtcctggccctgagacctggcaggaccagggaatggcagcctgggaaacctgggtgtgggatgctggggtccctccagccaccatctctgcctccaaaaaccaaaccagcaggagctggaagggtcagtgggaccaacctgccaggagcaggacatccgcattcattcattcaatacctgccatgagcctggtatcttcattctttccttcacccttccttcgtgccctcatccagcaaatagtggatatttgtgtcatgtgtgggacagctggcacactcaaacagggctgatccaagatcttaaagggaccattgagacaggtatgggcaggataaagggaccagtaaggaatggcaaagcccggccccccagggctggcaacaggagggagcagttaccacctggagttgtggctctgggcggaggcctgcggccatgccaaactccaagtagggcaaaaaatgccccacttctcttcggatttcttgctgggctcacttattggctaaacccagcaggaaatgctgggcaagggaggtttgcgtgttgtttaacctctgattcagtttcctcatctgtaaaatgggagcaacagtaaccccctctcttaaggcactgcgacgatcaagtgagttaatctgcatagagtgcctgtcacagggcccgcacgtagtgtttggaaagtgtttcctattcttattggcactgatagcctgggctaggggctcctgtgggaggcagatacaagtttcccctcatggagcctgtgctttgttgggagtcatgggtggaatgaatccccctcctcccagcctgggggtgctctcctcattgccttccactccccggcagctgagatagtgctgaggctgttggctggggcagggcctaggctgcgaggtggccccatcgtgggcacactagccctgcacccctgggcattggtgcgtccgccaagaaatgtttaggtttccattctcagcctggtttcttccccctcagggcccagcaagaaagaacagccccttctggccttcctgctgggggacagaggctcccagagccacttctgagttggggtacagacttcggtggctcatcagatgaaaggaggtgcagagagagcctgaagttggctctgtgatcccgacttggctgtcactggcctgctgggtgtccctgggctacttccttcccctctctgggcctcaggacccatatgtgagctcccagggccagccctgtggacacttgtagagtctggggaaaggttccgggcataagtggggggcatgggaatcggcctcccctgctcctcatgttacttccttaagtcatcacaatagccctgaaaagcaaaggcctcatctccatggcacaggtgatgaaacaggaagactgaagcccaggcctggccggcccacggccacattcaggccaacagaccatccctccttccacagaggagaagcgcatctaccgggtgcctgttttcacagcgcccttctgccaggccctgctggaagagctggagcacttcgagcaatcggacatgcctaaggggaggcccaacaccatgaacaactacggggtgctgctgcacgagctcgggctggacgagccgctgatgacaccactgcgggagcgcttcctgcagccgctgatggccctgctgtaccctgactgtggcgggggccggctcgacagccaccgggcctttgtggtcaaatacgcaccgggccaggacctggagctgggctgccactatgataatgccgagctcaccctcaatgtggccttgggcaaggtcttcacagggggcgccctgtattttgggggcctcttccaggtgagtgtgtgacccatgcggcagggcctggggcagctgtgagtgcccaggcctgagtcgtgccatctgcaggcacccacagccctgacggagcccctggaggtggagcacgtggtgggccagggtgtcctccaccgtggcggccagctgcatggagcccggcccttgggcactggtgagcgttggaaccttgtcgtctggctccgagcctctgctgtgcgcaacagcctctgtcccatgtgctgccgtgagcccgacctggtggacgatgagggcttcggtgatggcttcacccgagaggagcccgccacggtggatgtatgtgcgctcacctgagcttgcttgggcccagtgtgggggtggcaggcaggtgagggctccgttgccttggtctgggggcagaaataaaatccccgcagcctactgcacttcttggctcaacggtgtgccagcttctgggtcattctatgggcaaagatgctgccttagttcaggtttgtcagaagcagggtctggaatggggcttcagcgagggagtcagggaagcaggggaggggagggagcagctgggcaaggaagtggcttcagaggacgtccagcctcagctggccccacggagagctccaggcagagcccacagtaccacagtgtgcccacaccaccggttactggctcctggatgagggggccagagaggagtgaataacttcccagacacttatctccagggcagggtgccttccagtagccaagggaagcctccagagagcacagatgtgaaccctcagcagcaggcatcaccccccagtggactcgggtgggccaccagtagcatcttctagatggcagaggggtgaatggcagggccaggaaccaggctgcccgggttcccattctgcttctgccacttccagctgtgtggctttaggtgagccttcaccttttggtgccttcgtttcctcatttagcacctacctcctagagctgttttgggagtcaaatgcgctgacgtatataaagtgctttgcaagatccctttgtgtttgcggctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccgggtgcgcaggcgtggggcctccgggcacggggcgggcccttaacaggcaccgctgcggggactggagtcggcggagaaaaccggggtccccagcgctgggggtgggtgagggtcgctcattttcccgggacggtgacgggtactgggcgtcgccaggccccggccccgctagagccacccttggagcccgcccgcggccggccttgggggcttcggctcaagcgcgtcttcttcgtcgccagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggagggtgaggaccacaggcatcggggagaggaggcgcagttactacccggggaagtcgggcgagcagtggtcggggacgctcagtcatgcctctgtgcagccgggcctgagatgtgagggccaggcgccgcaggagccaggaaggggctcctctgggaagctccatctctgttctggaaagcccctcaggaagcgctcaccctgtagccggtctgtgcctgccccaggccagagcaggggacgaaggtttacctcttcccctcctggccttccagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatag

SEQ ID NO: 6818 - DNA, 583 bp, Homo sapiens
cattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggtaagtctacagagttcctcaggcctgtgtgcaggaaaggaggctcctgagggggtgtttgggactagcataggttggtatcagaaatcccactgcttttaagatcgttgaaagatgactcactctgaagcagttccaattcttatattgtcctgactgctgagcccgtgtgggactatatgagagaacctaggctcaggagcctgttgcctcatagggagacgtggcctagaaacatgaaatagaaccatctggagtttcctgtgttcacttccattgttatcaagatgagaaaattcctgtttatatcttggtatattaattgatgtgtgagggtatcaactgtggtaa

SEQ ID NO: 6819 - DNA, 576 bp, Homo sapiens
agtaatcaccaagactgtcagctgcctgcagttatcgggaagagcagcctggggaaagttaaaggagcacagatggacagttgctttctgcatgcaagtggccagctaggatccggggggcatcaagccatgatttttatttctgtgctggatgcattagcagctgtgacttggaaggttttatcctgaaggagtggaattgctgcagacgtcttggggttttggtgagcagtagatatttggggacattgtgctgttattgcagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccac

SEQ ID NO: 6820 - DNA, 3023 bp, Homo sapiens
atggaagatcttccagaacaagaaaaaaatataaatgttgtagatgaattagaaatacaattttatgaaattcagttagaactatatgaagttaaatttgagatattaaaaaacaaagaaatactgcttactacacagttggactctcttgaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcaaagaaaatcattggctcagattgcaacaggctgaagaaagcataagatattctcgtcagcatcacagtattcagatgaaaagagacaagataaaaaggagcaaaagaaaaaagaatgggtcaaccaagaacgtcaaacactccaacgattgagagcatttaaagatgtaagttctataaacaatcacctcatctacacttctggggaaataaatgaagaccgctctaaagaggaaagtattaagaacaggtcattcagaacatgaaacatttaaaaaataacattatttctggtatatcaataaaaagcaacaacaaaaatagaatatcagtgattcaaaacccatgatataaaataactgctgtttttaacatcacaacacgcttgggttcctgctctgcactcttcactgagtagtccttactggcactggtggtttagattggcagggaaaactgaaaactgttcaactcccttgactttagctggcatttcctctcatttgtaataaacaattctttaaaatgttatccaggcagcattgtgatataagtgtagtgaaagtgcccagttaaaagtaaaatgtgttgttgtttttttttgatatctacaactttcttttttctttttttttaaagtatatacttaagaggatgatgttatttttttatgccctctgttccaggcctacatttgtatttcctccacaaaatgatcctcagtctgtaatttttgttctatttgactttattattagagataaattcctttaattaaaaaaaagctactatgaaggttgaaaaaataattttttggttttatttttaattgacacataattgtacatatttatgaggtatagtgtgatattttgaggtatataatatggaatgatcaaatcagggtaattagcgtatctatcacctcaaacatttatctacaggtaaataggttttttaaaataaagtaaatagggagtctggcacagtggctcatgcctataatcccagcactttgggaggctgaggcgggcggattgcttgagaccatgaatttgagaccaggctgggcaacatggtgaaaccccagctctcctaaaaatacaaaaattagctggacatggtggtgcatgcctgtagtcccagctacttgggaggaaaaataccaattgtgcacatatttttgtaaaattatacataaacactttattttttatgtcattctaaataattttttgtatgtttctatttccaaacgttgtttggtaatatatagaaatatgattgattttgtttattgagtttgcatataaccacattactaaactcgcatattgagcattttaataggttattttgaatacttttacatagactgttgtctgaaaatagaaacaggtttatttcttcctttctgatgtggatgtcactgatttttttccctacattactgatctggctaggactatcagtataaagttgaatataagtggtaaaagatctgacttcttgccttggacccagtttttaaatcagttggagagtcaccattaagtgtaatttagtggtagttttgtttgttttttttttgtttgttttgtagatgccctctatcaggataagttcccttttctcattttgctgagagtttttataaagaatagctattgaattttgtcaaatgcttttgctgcatctgctgaaatgacacgtttattcttcatctacctaataatgttgcaatttatatctgttgagctttgaatgttgaaccagccttgcattcatggtataaatcacttgtttgtaaagtattgtttttaaatattgctagatttgatatcttagtattgtatttttatatttgtcttcatgtgtttttgttttctcataagtgtctgtacccccctttttttttctttaaagagaaataatgagagagattgtctctcttgaagttctcagtgcctgtgcattgctgccactacacagctagtatcatgacagcagcttcagaaccagagctggcttccaggcaaggctgggtggggaagaaagagaaaaacaaaagaattatttctctatgccgagaccagctcggtcagggagaccctaacctagcggtgctagaggaattaaagacatagacacagaaatatagaggtgtgaagtgggaaatcaggggtctcacagccttcagagctcagccacaaacagagatttacccacgtatttattaacagcaagccagtcattagcattgtttctatagatattaaattaactaaaagtatcccttatgggaaacgaagggatgggccgaattaaaggaataggttgggctagttaactgcagcaggagcatgtccttaaggcacagatcactcatgctattgtttgtggtttaagaatgcctttaagcggttttccaccccgggcaggccaggtgttctttgccctcattccagtaaacccacaaccttccagtatgggtgttagggccattatgaacatgttacagtgctgcagagattttatttatggccagtttatggccagattttggggggcctgctcccaacactctacatatgctccatcttgcagaggcttcattcttggttctctagctaaaaacagtagaaattttgcacacctggg

SEQ ID NO: 6821 - DNA, 1641 bp, Homo sapiens
gtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatc

SEQ ID NO: 6822 - DNA, 502 bp, Homo sapiens
taatgaaccgtccagcccctgtggagatttcctgtgagaacatgcgttttcttgtaactcacaaccctaccagtgctactctcaacgagttcccagaggaacttaagaagtatggagtgatgactttggttcgagtttgtgatgctacgtatgataaagctccagttgaaaaagaaggaatccaccttctagattggccatttgatgatggagctccaccccctaatcagatagtagatgattggttaaacctgttataaaccaaattctgtgaagagccaggtggctgtgttgcagtgccttgtgttgcgggattgggaagggcacctgtgctggttgcacttgctttgattgaatatggaatgaagtacgaagatgcagttcagtttataacacaaaaaagaaggggggccttcaattccaaacagctgctttacttggagaaatactgacctaagatgtgattacgcttcagagataccaacgggcactgctgtgttca

SEQ ID NO: 6823 - DNA, 769 bp, Homo sapiens
cgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagttggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggt

SEQ ID NO: 6824 - DNA, 1793 bp, Homo sapiens
tttccggcgcggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagca

SEQ ID NO: 6825 - DNA, 1558 bp, Homo sapiens
agagctgcgcgtgctccgtgccctcgcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaattgtgagtgtatttgttttctcccaaagccctgttctacatatttggacaaatgactcataaaattatagatacacttatttaggaaaaaaggtgattcgtgaatggaaatgccatgaaacaataaaaatatgaagcattatttatttaaaaatattatagttatcttagggattctatactggctgctgtacattgttctaaatttttgttatgttggcatcattttgagagcaaacaaataaaaaagactcctaatccatgctctagtttggatatacatattttagatattttccagttagcagtaattacatatgcttaaagtataaaactagatctcaaagtgtcacaaaacattcagtatatattgctcaatcaaaagaagtattcaaactgcacatt

SEQ ID NO: 6826 - DNA, 1209 bp, Homo sapiens
atacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggagacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaacgtatgtataaactttatttgatgaccttttctgctggatatcacctgtgtgttctaccatcaatcatcaacctaaactcagcatgtttgttcatttgtttcttcattcattcaacttttcttgaggaccagtaggtgtcaaggactctgctagacgtggaagaagatgaataacacttggttcttgtccctgaaaaactttcagtctgttagaagatatagaaatacaaggatgaattactagtatgtcccagtaattgaaaatactaaggcaagcttagtggaatagtgaagaagaaatgataaatcgtgtctcaggaagtagagctccaggaaaggtataaaaaggttacatttgataggctgggttttaaaggctttcagcttccctgtctgtaatacaagaaagaactgttgtcaagtgagaaaatccatgtgaaaatgctttgtgaagtttgtaaatactagctttgaagatcacacat

SEQ ID NO: 6827 - DNA, 4707 bp, Homo sapiens
gcccgccagtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcgggtacaaaaaccagaggccggggaaggcgccggtgggaggcaaggcacggatggactttacctgcgcacgcgtcgcagccatctccgcgcacagtggtggccaccgcgactggtgctgaagtgtcggcgtgtgccgggcgctccgctgggacccgggttgctcgccctgagtctcagctttctcatctgtacggttgggacaagtacagtaaccctcgcccgtcaagacgggccagggctgtggcgagggtccacgccttagagcaggcacctatcttgtgcagggccctgagatggggtctgactcagttcctgcggggaacttcaccagtgacccagtcagtgcccttcagttaaagaccaccaggagcacacttatatcatggaaatcaggacagtagcagttgggattgtggcaatcaaaggggtggaaagtgaattctatcttgcaacgaacgaggaaggaaaactctatgcaaagaaggaatgcaatgaagattgtaacttcaaagatctaattctggaaaaccattacaacacatatgcagcagctaaatggacaaacaacggaggggaaatgtttgtggccttaaatcaaaaggggattcctgtaagaggaaaaaaaacaaagaaagaacaaaaaacagcccactttcttcctatggcaataacttaattgcatatggtatataaagaaccagttccagcagggagatttctttaagtggactgttttctttcttctcaaaattttctttccttttattttctagtaatcaagaaaggctggaaaactactgaaaaactgatcaagctggacttgcgcatttatgtttgttttaagacactgcattaaagagacatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtatatcagacctacaggctgctggcaggatttgtcagataatcaagccacactaactatggaaaatgagcagcattttaaatgctttctagtgaaaaattataatctacttaaactctaatcagaaaaaaagaatattctcaaaaaaatctattatgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccactaaataacattttataattcctcaaagtaaaattgagaaatctttaagtttttttcaagtaacataatctatctttgtataattcatatttgggaatatggcttttaataatgttcttcccacaaataatcacgcttttttcctatggttactgcattaaactctatattaagttgtttttgaacttattgttttgttatttaagtttatgttatttataaaaaaaaccttaataagctgtatctgtttcatatgcttttaattttaaaggaataacaaaactgtctggctcaactgcaagtttccctcccctttgtgactgacactaagctagcacacagcacttgggccagcaaatcctggaaggcagacaaaaatgagggcctgaagcaatgcttacaatagatgtctcacacagaacaatacaaacatgtaaaaaatctttcaccacatattcttgccaattaattggatcatataagtaaaatcattacaaatataagtatttacaggattttaaagttagaatatatttgaatgcatgggtagaaaagtatcatattttaaaactatgtatatttaaatttagtaattttctaatctctagaaatctctcctgttcaaaaggtggcagcactgaaagttgttttcctgttagatggcaagagcacaatgcccaaaatagaagatacagttaggaataaggggccctgaatgttatgaaggtttgaggtcagcctacagataacaggattattacaaagatgaatttccacttccaaagtctgtcattggcagatcttggtagcactttatatgtttaccaatgggaggtcaacatctatctaatttaaaagctatgctaaccattgtggttttaatttcaaaatatttgtcatacaagtccctttacataaatagtatttggtaatacatttatagatgagagttatatgaaaaggctaggtcaccaaaacaatagattcatttaattttcctgtggttgacctatacgaccaggatgtagaaaactagaaagaactgcccttcctcagatatactcttgggagagagcacgaatggtattctgaactatcacctgattcaaggactttgctagctaggttttgaggtcaggcttcagtaactgtagtcttgtgagcatattgagggcagaggaggacttagtttttcgtatgtgtttccttagtgcctagcagactatctgttcataatcagttttcagtgtgaattcattgaatgtttatagacaaaagaaaatacataataaaactaatcttcattttaaaagggtaaaacatgactacacagaaatttaaatagaaatagtgtatatacatataaaatacaagctatgttaggaccaaatctctttgtctatggagttatacttccatcaaattacatagcaatgctgaattaggcaaaaccaatatttagtggtaaatccattcctggtagtataagtcacctaaaaaagatttctagaaatatgtactttaattatttgtttttctcctatttttaaatttattatgcaaattttagaaaataaaatttgctctagttacacacacttagaattctagaatcttaaaactgtaaggggcctccatcccttttactcatttgtagtctaggaaatcaagattttgatacacctcaggtcatgcagctgggtagatatacaactgtcacaagagtctagatcagttggcacatgctttctatactagattattagtattattagctaatggtcttctgcattttttggtttttgatttgtattgagatatagcctttacatttctacacaaatgtgactatgtattggcaatgcacttcatacacaatgactaatctatactgtgatgatttgactcaaaaggagaaaagaaattacgtagttttcaattctgattcctattcaccttttgtttatgaatggaaagctttgtgcaaaatatacatataagcagagtaagccttttaaaaaattttctttgaaagataaaatacatgagtttctaacaattagaaaggaaaaaattaaaatatgaaataacaaaagtaaacaaaagatactttcaaagcagtgaacaaaacattttgacataagccgtaatataaattataatataaaaacataaaaaccatagtataaattgtcagtctttgagttggccacaaattcaatttaatgaaagaagagaagggatgctggaggtaaataaattcttagagtttctatctcatagagtttgctcttctggttctctagactgccaaagaacataaagatgtacaaggggacctagctgtagtaaaagcatacctataacaacaaaaactctaaaacggtgcccctcacgattttctactgaaatttctctaatagtagaggtataaaataagaagttagagaataatacaaaaggggcccaccatagaaagcacatttcttttctcttaagactcatgtgatttttgcatcttactccataatgtattagtggttgcattaatatgacaatgtctgcaattaaacaccagtaagcaaaattgatacatcagaatgacttgcagggcttatcacgcagtttcatttacatccctaccccactgccatttacttgagcgtgaatgacacacgagagattctttgccttccataatccaactttacacataaataacacaaggctaaagaaaaccagaactcaaattcaccatgcataggagtgataacaaaaatatttaacagtcagtatgggtgatcactggccaatcaaaatacatcactgatatatcaaaatggatgcaggccactgtgactaacttgtggatatcatttctatgatcaccctaaaacagagttgggaaaatatcaattaactggactctctggtttgaattctcaatatgtatcttaatatgaaatagctcattaaaacttcatgtgtaactatttca

SEQ ID NO: 6828 - DNA, 2747 bp, Homo sapiens
gtgtcctttttttaaaaaaaccagtctacactctaaaaacatgatcttaacccttcctctatgaaaatctttcttacagataatgattttaaatgatatgatttgttttttgcttttgcataagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaa

SEQ ID NO: 6829 - DNA, 579 bp, Homo sapiens
aaaagcaactttcaaacattaggttttcagaggtctgtgggcaggcaggtcaggctaggagcacgcagcaccgggtggaccttgaccgtgctgccacctttcctgccctggagcaagtcctcggtgccctctgggttgagtttccttctctgggtgaggggtgtcggggtctgctctgggcctgtctcggcggatgggccttaacagggagctcctgcaggatgggcctttgactgcccccgcccccaacctgggcagggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgc

SEQ ID NO: 6830 - DNA, 673 bp, Homo sapiens
ctctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaagtaaaagtttctgccaaacctttaatggtgatttgctatgctatacggtgattctgcttttaaaacaaaattgcatctttgaaggccactgcttcctgtgtaatggaaaaaggggatttataaacatcatttgtttga

SEQ ID NO: 6831 - DNA, 969 bp, Homo sapiens
gatgaggatacacacacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctcc

SEQ ID NO: 6832 - DNA, 1115 bp, Homo sapiens
acctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacagcttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcgtgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaactttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagacc

SEQ ID NO: 6833 - DNA, 7430 bp, Homo sapiens
agccgtagacggccgagcagtggagcgaggccgcctaaaggagagccgcgctgtcgatgagtcccagtgggccacctggagcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaaggctggagtgcaatggcgcgatctcggctcactgcaacctccgcctcccaggttcaagcgattctcctgcctcagcctcccgagtagctgggattactgcagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttctgtctggaactgcttcctttttgttttattatttttccccagatgagctgactgggccatggaactgcatccttatggttcccatagcaccttaccgaggcgcccttatcaatagagttttagttatgtacctgtgttcttgtctgaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggtataggttctttttatttcaataataacagaaacaactgtcaaaaccatgtgcctgtactatttggagtgctgtccttgcagaatctcattataagaaccttaggaaataggcacatcatctcctggatagaatcctaggaaatgggcactataatgggcactttatcccattttataaacatggaaattgaggcacagagagattaagtactttcccaaggtcatacagctagtgatggaggagctagcatttgaacccggagtttttagtctattgagtttaaccgacagatcatactgtgttttggtagggagggagggaggaagcaagcaagtgaacaaatgagtctgggatttaggacttgccagacaaacaaggcccaagaggcaagtgtgcaggtgggtgtagttgggagtcagcagagttgggttggaattcaagctttgccacctgctggctataaaccttggttgggtaagtaacccaaggtaaatgagatcatctctgtaaaactcttagccttgtgcctggcacatagtaaatgcttaataagggttcactgttagtattactgttactgataacatacaaatagattgtattaatggaccataattgcaactgtataaaacaaattccatgtttggccaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaaaaaaaaaccacaacaacaacaacaaaaattccatgttgacaaggatgggaatatgagaacatggaaacagctatgaaaagacataagagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaaggtgttagtgggatacagctttctagttttttgccactagtggataggttggaatttaaattcttcggatattg

SEQ ID NO: 6834 - DNA, 3050 bp, Homo sapiens
aaattaactgggcgtggtggcatgttcctgaagtcccagctactctgtaggctgaggcaggagaattgcttgaactggcacccaggaggcagaggttgcagtgagctgagatcgtgccattgcactccagccggggctacagagtgagactcagtctcaaaaaaaaaaaaaaaaatatttatttttattttttattacaggcagttggataatatattgtagaaagaaaagaactatgattcaaacagtttaataatgaaatttcttcaataaatcaagcattattcctctgcaggagttttgtgtacattgtctagaataatctttcccaagctttttgcatggctgcttcattttcacctttgaggctgcctgccttttatcttggattaaatgtattctcttatctaaattctcagtatttatcagagcaccttgtttgtttgagtctagcactttagatattatttggtaatttactaatttattatgtatctcccccagtaaattttaagctgagaacagggactgtaactgttttactcacattatatttgtattgctttgcacagagactagatattaaatatttattaaagatagaaataaggaagtgatgctactttgtattcaaagctttatatattcctagacctttgcttatctgttaaaaacaagacctagcatataacatatattagatgctcagtaaatatgtttaatgaataaaaccaaagttatcttctggaatcataatacatgagttctaatacaccctggtagatagaattatctagttcttatacttttatttgttgttgagatggagtttcactcttgttgcccaggctggagtgcagtgacacgacctcagctcactcctgggttcaagtgattctcctgcctcagcctcccgagtagctgggattacaggcgcccaccacaacgcccggctaattttttgtatttttagtagagatggggtttcaacatattggccaggctggtcttgaactcctgatctcaggtgtttcacccgcctcggcctcccaaagtgctgggatcacaggcgtgagccaccacgcctgtcctagttcttatactttttttttttttttttgagaccaagtcacgctctgtcacccaggctggagtgcagtagtgtgatctcggctcactgcaagctctgcctcccaggtccgcgccattctcctgcctcagccttccgagtagctgggactacaggcgcctgccaccatgcccggctaattttttctattttttagtagagatggggtttcgccatcttagccaggatggtctcgatctcctgacctcgtgatctgcccgctcagcttcccaaagtgctaggatcacaggcctgagccaccacgcctggcccctagttcttatacttttatgaaagacaaagaaggtgaagtgctcccctgaccccccaaccccgaaaaaagcttagtaacatgctgaaggtcacatagttttgttgtggtgacctggcctgttttgtttttaacagcaaagcccatgtgtttttcttgcactttgtttaccgtctgactactgccatttccttaatttcaaagattttcaacttgaatcctcaatttcttcacatgaaaaaatggaccatctagattagatggtttctaaggtctgctgtgattttaaagttatgtagcattgtggctgtatgtcttcacagcagttcaagaatattgcttttaaaggaatttgtagttctttgttgggaaaattttctattattttgcttcctcataagtgatgctcatcttttcaaagaaatacatatacatttttaagtgtatgtatgagtagtatgtgtatttctgtctacaaaattataaaatgatgaaactattctgtcatacctagaatataaaagggaaaaaagtgtgaattctttaaatatttttctatgtcctaatcactggaagtcctatagttgtttcaaactgttctgtaaaatttgtcttgttgcttatgttcaaaatatatttccatgttttagtgaagaaaagtacaaagtggcttgacagaaagtgaaattaagactgctggtaatcctttgaagagacttagtaataggagttggcaaatatttaagagtggcattggagacaaatggcagattcaggataggctgtttctgtaggaagcatggttctggatgagtgctgctcataaagtcattgaaagttattccagatagtttaatagaagtgtttgtttagcaaagacaacagattttgctattttgactgcattgattgtattagttcagatttatgaaagaaagagcccggaatacagaaataagataacaatagaaaatttaagcatgtcaagaactctaatgctggaattgtcacagcaaccacaaaattactgggcatcaatagactcctaagaattaagagaaattgcagaatgtaagccataattgtcattttaggaacattatgctagagcacaagtttaggattgggcaaaagagttgatttttaagattgcattggtgttctctctctctcttttttttttttttttggagacggattcttgttccgtcacccaggctggagtgcagtggcacaagctcggctcactgcaacctccgcctcccaggatcaagcgattctcctgcctcagcctcctgagtagctgggattacaggcatgctccaccatgcccggctaatttttgtatttttagtagagacagggtttcaccatgttggccaggctggtctcaaactcctgaccttgtgatccacccgccttggcctcccagagtgctgtgattacagctgtgagcctccgtgcccaggccagtgttctctcttaaatgtgtttcaatatggtggacatttattgagcacttgtgttgggcgtttcaacaggaggcactggtacgaaaagtagcttgttctagttcatatatcatttgcactttgcttaacttgtataagtactttttactgtttaataaatattttattagaaaatact

SEQ ID NO: 6835 - DNA, 1394 bp, Homo sapiens
tccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgtttacacctgtg

SEQ ID NO: 6836 - DNA, 1698 bp, Homo sapiens
cgcgagcggtgaggggcgcgccgcggtcccaggtggaccccgcccccggagcccgcccaaccgccggtgcaggcccgctccgtccttgcccaggctccctcgcgggctgtgcgtcgcgttcagagctgccgctggttgatttcacggtgctttccaccagcaagaattgggggtggtgccgggctttggcttcggccagcggacttgggttccctggccgccccagctacccgtcttcacgtttccatctgttctcagctggggggtacgggggaagatggctggaaggccccctgcccctgactcccacttcccagcctctctgactgcgggctccttggcctagcaaggtgcagaacacctgccacctgcacctgagagccctcccactccaaagaccttccgcaccaagacctcgtttctggcagtcatgtctcctctgaaataggtggcagttcactttcacaatttttaaactggtgagaaaggacttgaatgtggctagaggagggcaggccggaggccacacatgcaggaaggtgcctgatgtacaagcccatactggccggaaggcaggcctgggtcagagacacggccgcaagcccctcctgtccacatgcccagagtttagagacaccaaggtctcagcatcacctagaacctctgagaagtcatctcttgatccccttgacaccaggacttcagagatgcccggtttcaaaagaagacaagcaagggggattcctcagtcaacacccattttcccctctctcccttgcccaccgaaagtgatttataagcacagcagaaatcaaaacaaacaagccatgcttggaaaacgaggatccacatgtgtaaataaacgggaactacagctcaaaggcagtcatacacttgtcattcttgtttcttcctctcatgacatggaaaggcaggtagaaagatctcttgaaggttgctccgaagcccatgggagtgaatgttccggtggacttggggctctgctgacggaggccaggccacaaggggacaacgctggcaccaggcccagtcacctctgtaccactcgttagtagtctggttggtggccgccagatacaggacaaacaacaggtagccacccaggaggaagctcagaaccacgacaaagcccagcatgaagacaatccgtggaaaagtcaggaacaggtactaggagcagagaaaaggtagtgctttaggcagctggactgtgacatccatgagagtgaacactggccaaccctgggcctgccacagccaccagcgctgcttcctcagcccacctacttgtgtccagatgtgacaaactgaacataaacagcactgagaagcagcccagaataatcccagtacatacaagagtttcctgtgggatgaatgaagtgttcacactgaaggaaaagggaaagtttacttaggaaatgtgctattccagttagctatttataaaataaatgcagacttcattcatcaatataaaatccagatggacaaaagagatcaatgtctttcttaaaacaatacaaccccaaaaatagatgtacaaggatattcgttgtatcattgattttatcagcccctcttccgaagtttttttccttttcttaataaatagaaacaggggccgggcgcaatggctcacgcctataatcccagcattttgggaggccgaggcgg

SEQ ID NO: 6837 - DNA, 624 bp, Homo sapiens
ggagtccttagaaagggggctggtgtccgtacgggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtaactgttactgttcccccaaacaaagtagctcactctggctttggatgaaattcgactgcttaaaaaggaccttggtttaatagaaatgaagaaaacagactcagaaaaaagatttggctctgtctcatttggaagaagctgcaggcttattccccatgcacttgcttcctggctgcaaaccttaatactttgtttctgctgtagaatttgttagcaaacagggagtcctgatcagcacccttctccacatccacatgactggtttttaatgtagcactgtggtatacatgcaaacatccgttcaaaatctgagtcggagctaaaaataaaaaatgaaaaaacagaaataagaataaaa

SEQ ID NO: 6838 - DNA, 1123 bp, Homo sapiens
cttgtgttctgtccaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagaggtgcaaacacagatgatccttctatagagaaagcagagaaggtttagtcggggtccatccccgggcaggtgccgccctggttagtcacgtgaccctgcatcaacgtcacctgctgatgggcagtcagcaccgtcctcagaaatgtgatacagccaggatctgtgtgcccagggcgtggccagcgggcttgggcccagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcc

SEQ ID NO: 6839 - DNA, 631 bp, Homo sapiens
ttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcagttacattttatattaagatttcacagtcatatatcttaatgttgcctctttccttgagtccactgtctagcttggcaagtgtaggagatagcaatttacaaattttataaagagaatttattattttgaaaaccgtaagctgtattaaaatgcatggcatttttactcatccaccaggtttttacttt

SEQ ID NO: 6840 - DNA, 801 bp, Homo sapiens
aaaactgaggaagaaaactgacaaggttttcaagggaatttccaggtcacccagagaactcgccttgccttgttctacttcctacaagtctctaagcacttcatgctttactagaatcttgtaaatacaaaaaaaaaaaaaaaaaaagaagacacacaacaagtcaacaacgtaacaatgtttggcatcactaaaaagatggtactttggtgaaaggtagaaattggaaaaataaagctcaggacaaccttcaagtttttctctattcatgctaccctctttttttggtaaccacagttaattaagagttataagcataaaacagtgtttctttcaagtggcatgcttatgtgggggaagaaaagatgaaagggaggcagctcagtggagaaggagcatattgctaatcaaaaatgaaatttctccatcaggctgagaatctacgatggccagtgagctggtatgattcatacgaagttccatgtctcacttatctctccaaatcatggttcttcacgagggagcccttcttcaggctgttcttccgctccacgtagttggacggtacatagcccgtcctgttggccgcgttcctcacccgccaccacgtcttggagtcgtccagcaaccacagccgctcgttcttcttgatgtccagctcctggtcctgctgggcggtgtagtcccacttggctatcacaataacttcttctgtcatctttcatggagtccttctgccagcaaaacatttggagatgctcattagagaactacccggacacttcatcctttgcaccaact

SEQ ID NO: 6841 - DNA, 720 bp, Homo sapiens
gcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgatagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctcttttcaagatggttaacataacagacaccaagaaagggaagaggagccgacagcagagggggaagctgaaaagacgcacaaagaatggccataaaagatatgagtatgttgagtgattagtgatcggaaactacgagtgatatggtacaggtgtttgtagaagaacagtaaagccattgatcaggtcagctatcaatgaactcctgctagagaaggg

SEQ ID NO: 6842 - DNA, 816 bp, Homo sapiens
tgggaggccaaggtgagcaagtcacttgaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgtt

SEQ ID NO: 6843 - DNA, 799 bp, Homo sapiens
gtgagcggaatcctgactggttcatcctccccggaacttcctagacgccgtacgtgccagatggtgttacctggagcttaaaaagctgcacgcaagtgttaaacttctgacaatggccaagaacaaattaagagggccgaagtccaggaatgtatttcacatagccagccaaaaaaactttaaggctaaaaacaaagcaaaaccagttaccactaatcttaagaaggtgagtattagttaagcactctgactttattgtttacaagcaaagtgtcattgtaagctactgaacagctgtatactattactttttaaaaaggttcttcatttttcctagaaaggtaaggatggtttcaagcatttgtctaaaaaaatataaaaaaaaaggaagaaaaataacctccctttcttgaaaacaaatgttgaaaagaaataaacattttaactacaaatgtgtgaagcttcaatttaatagttttactgaaccatagaactcatttaaaaaccatagtatgggaaacagttcttatctctaaactcaaatgtaagaatgtattaatagaggcaagacatgggatgtcagtgagcacccattctttttctcctcagtaattcttgtatctttgaagacatctgcaattcaaacaaaaacctgtaaaatgaagataaaaaatatttattgaaatgcacaatttgaaaggggtttcttttctttgtttatatttcaaaatacctgagaaatttctacaagatttaagaaaaatttttaagaaaatgttttcaagtttcagtagtagat

SEQ ID NO: 6844 - DNA, 2005 bp, Homo sapiens
atcccgctgcagccattgccgcagacacgatgccgaaacgaaagaagcagaatcatcaccagccaccgacacagcagcagcccccgctgcccgagcgggaagagactggagatgaggaggatgggagtcccatcggaccacccagccttctgggccctccccccatggccaatggaaaacctggcgaccctaagtcagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaa

SEQ ID NO: 6845 - DNA, 690 bp, Homo sapiens
acattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcggtgagtctcctgctgatgggacacaggcacctgggagtgcctcacccagcatgaatggtgaagaggctggaatatgggcaggtgggggaaggaagggtggaatgttgcctgggcaagggcagaggggagtgttgagagatggacaagatggagtcagggtgctgggtggggggccctagcaggactctgacccctccctcccctcaagatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttg

SEQ ID NO: 6846 - DNA, 776 bp, Homo sapiens
ggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctgaga

SEQ ID NO: 6847 - DNA, 946 bp, Homo sapiens; identical to SEQ ID NO: 2538

SEQ ID NO: 6848 - DNA, 571 bp, Homo sapiens
agcacttttgtatatgcttctaaatttctacatgggactttttccttctctattgtgtgttttctttttgtatccaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataatagg

SEQ ID NO: 6849 - DNA, 1012 bp, Homo sapiens
attttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgattctctcctcagaatacatctgaggaacttaatagagaaaaagtaaatgatgaaactacatttgaagctaagaatggaaaataattgaaagaattgaaagtggccaagataggaagaacccagaactggtacagaatgatagttttgaaagtcaagttacacctgacttgagactgaagaagttaatgtagaaggaaggaaaagcagaattaatggatacatccaatgcttctcatggattttatttggctgatgcacctaatttcagttgtttttcagaataaagactttttctttgaggaatgtgagagaactctgaatttcacaatgcaactcttctaagcaaattggaaaactgcactgaaaatcctgaattttgacatgtagctccctcaagagaaaaactacgagatgctttaaaaaaatgctgctgggtttttactctacgatgaaaaagaaggttaattcaaggaggaccaagacttcagatttcttaggttgtgctacagtagtctttgaccacaatgcagatttgattaaatcttgtaaggatgccgtaaaactggcaacagtcactggatacctggatgtagtggcccattgacatctggatggctcaaagggtcattataagataaaggatttggtccaatttagtctagcgagaggcaaatctatttgagaaagaaa

SEQ ID NO: 6850 - DNA, 2816 bp, Homo sapiens
ccgaggcgcgagggcgtcctaagcagtgggacttgggtagttgaaagaaagctgaaaaacagccattttgatccatgattttgaaaaaagggcctcatttcccaggtgaggcggatccccgctgcgtggtggggagcccaggggctggcgacaggaggtgcgcgtgtgcagcggccggcacaggggcctcgcgtttaggcgtggcccggggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcgatacttgtttctggatggagacagccactatgaaatcgaaattgtacacatttccaccgtgcagatcctcacagaaggcttccctcctggaggtaaatgccagcacgtcctttcctaagccaggagggtttggtgccatgcgtgggtgacaagaggagcatgcacttttgggatcaggcagctgccctgaggagtggggtctgctgggtttccaggacaatctgcctttcctctttcgcggggcgtgtatttactcagtggctttagaactcgccaggtgagtggagacttaaactgtaagacaacaaagggacatttgcctcagcatgtcataatgatttcctctgctctaaatgctctaacgtatcattcggtttattgttggattcaaaccaaggataaagccccaaatgcaataactgagatccccaaaaaggtctgaatggtggctcatcgggagccagcacttcagccctcctcctgcaggcgtctgtgcagactaaacccctggtgcatttcctggtgagctttggcccatcctgggcctctccactaaactctgctgacggggagctcgcatcccgttatctgcaaactgtgctgacagatgcgtgtgccgtaacccatgttgctttccttccgttctctcaccggctcttggttgctccttctcgccactgcctgcccaccttcttgccatagaaaaagacattcacgcttacaccagcctccgggggagccagcctgcctctgaaggtcagcctcttcctcctcaccggggctccccgcatgcagcgggcccgttcctcccctcgccacctggcttctgtccacggggtggtccatgccaaggttctttgtgaaacctgaattcacttactttggttgacttaagagagatgttggatctgataagtgggtttataaagcataaatgaagataccgcagcagatgtactttctcagttctgtctcagcgggagggttacccagcaattgacagctctctgtcagtacctgccagccctgaacaggctgaggccagggggcgtgggggctcacctgcccttgggagcctctgccaacactgcccttccccccgaggcctgctgctccccagctcagtgtggcctcctgggacccctgactctcctggcacttctgtcagcctcctggatggtgaggtgagatgcccaggccagtgttctgtcctgagctcagggatgtgtgtggagccgggatggcatcaagctggttgccttgagcaggctgcaaggtatagatgcccaggtgcaaagggtagggtctggagaagcgggggtcaccccaggcacccctctctgcctgcctcctcctggggagcctgaggctcagatgaaggccagtgtttaggggcatcagatgaaggccagtgcctcaggaggccagggcaacacagcctcccggactgctctcccgggcagaccctccccagggcttctggcactgtgtcccccttgtggtggcttggggggtgcagtgagccccgctctgcccagtctcagtagagcccttcagaccccagcaccctgtcttccggtgggggtggggacaataggaacagtcccctgacctgaaggcagccaaggggccgcctgccagcctgggccctgtagggcaggccacacactcattctttcaaggccagatagtaaacctttgccagccacgtgtgctgtggtgaaggcggaggcggctgcagaagacagggtgacagacggccatggctatgatccagtggtgctttatcaggcaaatgcaggcggtaggcagagccatggtcgccctgctctagagcctaggcaggacgttacactgacaggcaaggttccccagtgttgggggtgggggtgcgtgccctaaccacagaaccgggcttatgaaagtgtggttctagaggcccggcatggtggcccacgcctgtaaccccagcactttgggagactgaggcgggcagatcacctgaggtcaggagttcgagaccagcctgggcaacatggtgaaaccctgtctgtactaaaaatacaaaaattagctgggtgtggtggtgggtgcctgtagtcccagctactcgggaggctgaggcaggagaatcgcttgaacccaggaggcggaggttgcagtgagctgagatggcaccactgcactccagcctgggcaacagagactcaaaaaataattaaaataaagccaggcacggtggctcatgcctataatcctagcactttgggaggttaaggcgggcagatcacctgaggttgggagttcgaaaccagcctgaccatcatggagaaaccccgtctctactaacaatac

SEQ ID NO: 6851 - DNA, 578 bp, Homo sapiens
ctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggcaggattgcagatgttatgggctgatgccaaaaaggctagaagaataaagacaaatatgtggaagcacaatataaagtttcatcaacttccataccgggagatggagcatttgagacaggtatgggccaggggcagatatccagaagttcatggtgaggtaattacatttaatcaagatctcaaggttttttctttcatttgttgttcaccattgatcaagcttttgccctttgccgtgagaacaaaatattgaactgaatgaggcatcagat

SEQ ID NO: 6852 - DNA, 541 bp, Homo sapiens
agatggctgcgagtaagtgcaggttccggtggcgcacggggctcgggtagttctgggaacctctgggcggtcctgggactgaggtgcggcagggcaggggtggaagcgatggggtccgtgctggaggggaacgcagaagtcacgagggggctcctccagggcaggggtggcacgagagggttagaggtcaccgggggcagctacttgcaggggtgacgcttcttgccaccccttcaggagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 6853 - DNA, 2174 bp, Homo sapiens
cgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctgtaagaagaaaaagagcaaagataagaagagaaaaagagaagatgaagaaacccagcttgatatgttggaaccatagccattgaagtggatgagggaacctatatacatgcactcaacaatggtctttttaccctgggagctccacacaaagaagaatcgccctgaaacctggctatggaaaatatcttagtataaattcagatgaacttgttgttggcgttcagatgcaattggaccaagagaacaatgggaaccagtctttcaaaatcaagaggtcagaaatggtgggccagctgagatgggagaagaaaagagaaatggcacaaagtggagagaagacaccgaccatacctcctttcctctctttcccaccacaggtggacagcccaaagcacactccaactggaggaaggtttgccattaaagataagctttaaatgtcatttaagaagaaaaaagaaaagaaaattaagcatgacattccccaatatcctctgctcactgtgttataatccctatcactccacaagtgaattggagagagtgaagacacaatgaacagaaacttccctgatgcttcacagaggaagtgttctccgggaccacacagcctccaccatgtccatctacgaagggctgtggcaagccatatacacaaagatgcctgtttcctgtcttctcggttaaaaacaaaaacaaaacaccggaaaaagccaagctgccatgggttgcagagtgccagcccttaagtagtgttgttcatgggtaaacaggagacggataagggcaatttcaagaaataacaaactcaaggcatgaatgtggttatccaaacatcaagggactccttcatttgcatttggataattgtgcagttatatgatttgttacatggagaccagatggaagtaagagagctcatcctcaacttcctgtacctctggaagtctttacacacatgctggagagatagaggagagttcattagcatcaaaccaccatggatttcataatcaattcctaatatctgaatagatgcagaaaagtcacaggcatctagaagtgtggcccaagttctgttcttcaatcagcccacccattatccctatgtatctcgattttgttatctaaaagatcacatgatggaggatgtaagcaagtaacacagccaagacccagtttacagtgtctagtacctaacagactcttgacacgtttcacttgcccttgagtcagtctttccatgtcactgaatattcttccacaacacgattttaatggatatagtcgtccattgtttaaatgtaccattattgaccaatgtaaaaatgttcttttacctcaaatttttatatgtaaaacaaaaacatgtttgaggactaaacccacagtgtagtataaattaaactggatgtaggccaggcatggtgagtcacacctatagtcccagcactttgggaaaccaagacaggaggatggcttgaagccaggagctcaagagcagcctgggcaatacagcaagacctcatctctacaaaaaaataagaaaaattagctggccatggtggcgtgcacctgtagtcccagcttcttgggaggctgaggtgggaggatccactaagcctaggagtttaaggctgcagtgagcttggataacgactgcactccagcctggatgacagaac

SEQ ID NO: 6854 - DNA, 5329 bp, Homo sapiens
ttgagctggagagagaatcaccccatagcatttaatggtattctgtgagacacgaagactctagtcttctaaacttaaaagtggttaggtagtaccttaatcatcaaagatttttcacttacatgtaactggttaattcatatagagtttgtttagaacagaaactttaaaaggagggaacaaacctgagcaatttttaatcaaaattatcagttagaaaaagaatttaagacaaagatttattgtcctgaaagagtcaactcactcatatccaaaacttagaatgtcagagacttttgaaagttttctgaatgtgtcaacttcttcagcaatgagagattcaattaatgttgtttctaggttccttagagttttatcctctgatgataacacttaattgtgaattacatttaagtgatttttactttatattttccatttgttacagaaaaaaagtcataaatatgacagacttaaaaattgtggcattgagccagggtttgcaaatttggcaatattattttacttaaaatattacactttttaaaataacataaacattaaggataatagtcaaataatactgtattttcagcttgttcacattagaatatagaacaacgcattgtaaacttctcggaataaaatctaagtcaaaaccaatttatgttcaaatcatttgaacaacaaatatgaatattgttacatcacctctgactctctgactagtaagaaactatgcatttccatacccaatgaaacctcaattcctacagcaattctacttttattgcctcccaagaactatttcttcatggtcaatatcactctttaaaagctagcaaaatatgactttcttctgaggtttgggcaatctggatcaatatttatgtatctaaccacttgaaaggctgtctccttttttggccttttaaattaaaacttccataaaatgaagcaaaatatgaaaacagctagttgatttatcaataatgtgaaaccctccttctgaatttttttggtaaaaattaccacactgaaaccaaaacttaaccttggcttggactctcagataaattgcttttgtattctttgactacaaagtattctcaaaaagaagaaattatttctgatggtagatcaaactctagccaagaaggtctagataaactagaggactgtataattatctaaagtaattcagggggacttttagaaaaattctttaatttttgttcctgtgtaaaaattattattaatggatggcagcccaaattactattcttcttttaaaatttgtttcaagtgtgtcaccaggcactcataaaattcatttatttgttatataactcaatgacctgaaataataggtgctcattgctttttcatttgatccttaaaaacaattttattctgtctaaaaaaaattctcctgctaaaatccaaatgattacctggctataggaggagtcccattttatgaacatgtatgaaatatttagttggattcagatgaaatgcaacttagagaaaggaatggataccagtagagaagatggaaagagacacaaaaatcagactttgcttacatcaaaattaggtctgttgtctaatcctgttaacctagaggcaagctgaaaatagatggtaaggataaatagatttttaaacacagtatttatatttaacagaatgtcataaaaatgacagaatgccatgaaattcagcatgtcaaaactttgataaaacaaacaagaaatttaataaatatgctaattagagtgaatatttaaagggacaaaaataacttgtcacatcatagatgtctccccagtgcagaatttattatctgctgggaaaatttggttttatgtcttcaatcaatatttgctgcattatctaattaaacattagtatattttttgtgctaatgagaaaccatgcaagagtccaaatatcaagtgtggtgacagcttgaatcagttgagtttggtgttcatgaataaaattcttgatgaatgtgaaatgaatggtttatatacataagttttatgtgcagtaaattaattaggctttaaaacttgttagcatgcttagctcctcttttttccattgaattatcttcctatcttccttccttccttcctttccttcctttccttccctccctctttgctttatttctttctagctcttataagataaatgacaatagtactttactatttgggctggagcctccctttttcactttcacatgattgaacactttgtggatttgtgagaaaaggggaaagaagatgagcacgtagatgcagatcagttgaggatagaagtgactgagagaattgggaccttgacttccagagactgtcagtcaagagaaatgtgggtctataaaaatctatgtgtgttcattttcattgaatttaaacactttttcaagaagtatcagggtcaatctgtttggacaatctcctatttttacccccttacaaatgtcttaagttagaaaaacctcttattttcaagtagtcatttttttttatgtgagtaccacactgctaaagactgaaatagaaaaaaaaaatgctttttctgtttgtagggaaattgctttctgaaaactactcccaataagatgtatacatcaaatgcaacttgattttactggctctttatctagagataactgatgcactgtcttctttcttagatacccttctgtaattcagcttggcatagtatgatgttttgagttcttattgagggtttggaaacatttgtcatcaattttatgtctactctattgaaaaagcaatatacaatgtattccatatttcttagctctgtgtctttgaggttttaaacctatattcagatagctgtttttagctacaattttgagtattcaccagaatttacaaattgccattttattaaatacaaaaaaaaaaaaagtacagcttggatcaagagatcaaacatttacaaatctcaatccaaagccattatttttcagggaaaattaaatcatttctagcagagtatttgactcctaagggaaaataagtcaaatatcttctttaagagtaagggcattcttccattgtaggtatttctaattgactttataataatttgaacaaatcttgaacaagatttaaagaatttataatctcccaaacttaaaattgtattctttctggttttttatttttatgtattaagattatattcaaaccacttaattatcttcatgacataagtttgtgttaatagaaaattatacagaaaaaaacatgatttgttcctctgtggaaagatatgcttcaatgagttaaatacccttgaattttggttctcatttcttatttggacttttctgttatgtacctcaggggtcttaaattctaacagatgaagtagtcaaaggggtataaaatacttgaaaaaaattaaaacttcaaaagggacgaatttctctgttaacttttgtttatcctatactgacttattttgaaattgtgaaaaaacaggcagctaccatataaattggtatctatgaaaatactgattactttcttcctgtgattttcactgttaagaaaacctttgtcttgaaatgatggacaatcttaatacttgttcagataaagaaatgtgactttcaatacctttaccatttgtatttctttagggaaatattttaataatgattgtaaaaatagaagaaatatggttgagaaaaatagaagaaattaagatgaaatttgaacagttgtaatccacagtcccatttttccctctattttattgccttctactaagttattgaaggcccagatctgcaaaatttacaagctactaattcattgtctcctttaagaatttggagcaaaaattattccgactatgcggaaatgaattcacatcatcatggcaggttttgactatgagggaattcaggttaggttcaaatagaataatggtccatggagaaaaatactttctgatttttcttcaagttggatggaaaggtttttctttatttaaaaaaaaaaaaaaaaagtcctcctgagaattttgccttcgaaaaagaagttttataacagctgcctgtagctacattataacttcggtaattaagtgacaaaactgtctcattatgcttttaaaatactgattaagtgcattccagaaataatacatatcattcatttcaaaatcaacctacctgaattctgactcttcaatcatgagtagccattttacaaaaccaaagggtctcatttcccaaacagtactttaaatatcatcctaatagtaatatcctaatagtaataatcctattaatactcacttcaatgcataaaataaacagccaatgcacttccatcaagtctgcaggcactatataataataaataggtttccaaaatcacttaataaaaacacacagttataatgtgctcggccttcattagcatcctctgcatggggtggttttcatttaacctgaattattttaacattttggctaatttgtttgctgcaatttcatgggtctaaatttttggtttggtttgcaatgtaaatcatattgtatatctgctcctttgttattagatttactttgtgaataatatcttttaaaaattgagttatcaaaaacttaaattataatgtcatcaactaataccaggtaaatatactaatatatatgtagggcatgattaaattgcatatattttgaaatgtcaaactattttttgtttttttaaaaaaatgaatgcatctcttaaacctgtaccattaattttaaaaaagtttcatttggtatttcatattatattttaaaatatttttctttatctagtagtacaggtttaaagaaactttttctgattgaaatgataaaatatgcctcatttcactagaattttaagaataatacatgtaaaagtataactcatataagattataaatatccacaatatcttctttgattttcatgtaacaccactttttactcattcttttatttgttattattcgaaatcattcacaatgtaaatagcatgtttcatgatgtaaaatgtctttgcatttacagactgcagaacaaggtgaatttgtatatgaaaaataagtgatggaaacgtgggattcttataaaacaaagtggaaatgatagttctgtgttatatttacataattcattacaaaattgtctagttaagtcatgcatttatttaccttaaaagtgtccaaactgtcacttataaaatatttaaatcaataaataataccaaaaaggagtctgaa

SEQ ID NO: 6855 - DNA, 934 bp, Homo sapiens
ggaagcggccaagtccacagtcctgctcccgtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacaggtgaagggggcgcggcgggccgggctgggcagccgcgagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaag

SEQ ID NO: 6856 - DNA, 612 bp, Homo sapiens
aactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcgggctttcattgtctaacgtcgacagtctatatttctgctcttcagtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgt

SEQ ID NO: 6857 - DNA, 1802 bp, Homo sapiens
tttgggggagagacatcatcaaagtaggtttgtgtgtgtgtgcatgtgtgcgggtgtacatgtgttcaccttcccacccgctgaaacttcagatgcagtgaagccttctcacataaaacaatataccttaactgggcgtattgctctgtgggattcaaaagtattttgtaaattctggtcacttgagggcttcttggaatcaggtttttgtctagtctgtgagcacttctgccagttcctgaaacatgggctgccgtgcctgcttcccaggtgccgagctgtttccttcaaccatggtcaccctttgtctcaccatctgaaaggacacacatttcatgtggagtgtggtcgcttggagtctctcaaaaacactcttttttttcccataactttatgtagtttcttaggtaacatgtgctctatttttgtaagccactctgagttcttttgggctgtgtgtaggtgggcatggactaattttagggcgtgatgtggaaatagtattcgtattactgtttaatatgttctcctttcttttattaggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacag

SEQ ID NO: 6858 - DNA, 1561 bp, Homo sapiens
gggcaaggcaggaggattacttgagaccaagaattcaagtccagcctagacaatgcagtgagaccccttctctccaaaaaatacaaaggttagccaggcatgctgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacagg

SEQ ID NO: 6859 - DNA, 620 bp, Homo sapiens
acctattaatatcaaaggttgtgaatgtagtgagaatattgtagacactctgtcatctgggtatattttgtgagtggactctggttagttttactgattggtgctgttgacttaatctcacctgctggatggcagaggagttatggcagttttaaagtggaagatctcaggatggctggaaagagccctatcagctgagagcagtcttcacccttcaccctgatgccagcagtcttaccaggactctgacccttttttcttggaaaatcccacgagccatgaagagattgcaatgatctctcataatgaactcttattattttatgacttgtcttttgcttcaaccgctttcaagattgatcttacaatttggcagattttgtaaatactgtggcgttttgtgtacccattaaatttatttgcactgatggttacttttattacaaaaaaagattggttacagtttaatttccttgttcagtggaggcaatgttcactgcaatgtgcgaatgccaggccttgcatccagatcctgaggatgaggattcagatgactacgatggagaagaatatgatgtggaagcacatgaacaaggacagggggacatccctacatttta

SEQ ID NO: 6860 - DNA, 629 bp, Homo sapiens
atccctcttaccgggtctccttctcgggactcccttcagtccacttaccccgtttctgccccccaggccttctctgggcagtgactgtgagggctgacaggaaaggcatgtgcagcgtgcttgtgaggagctcagcacagagggtggggtgagggcatgtgttgctgaagtctgcatcctgaggtgcctgtggcaaaccactcttcccttctgtctcctcagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatg

SEQ ID NO: 6861 - DNA, 625 bp, Homo sapiens
attacagtgtattttggttattgagtgaatttatataaatcaacaaactagttcttaattactctcataaaatggttgagtaggtatcaccatataaattaatataatgttcctgtgaattttttcaaatatatttggatataaggcaaataccttcaaataatgacactcattccggttttgttgtattgattttgttattttctaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagag

SEQ ID NO: 6862 - DNA, 2087 bp, Homo sapiens
ggcacgagaatcgcttgaacctgggagctgtggaggttgcagtgagtcaagattgtaccagtgcactccagcctgagtaacagtgtgagactctgtctcaaaaaaaaaaaaagtgaaatatatgaagctgacttcaacagtaacagatttcagaaaaggtctaaaaactgtgctccagaatttaattaccacaaggagttagaaaatccacactaccatccagcttcctaaacagaagactaaatttcccgctatccctgtctttaccactgtactcacccccaccctagactctagtgtagaacaagtagtcaaggaaagagagattaaaatggtcactcatgcagatgatacccaaatgcaaacatgacacgcttagcaactggaaacctggtgggaggggcgcaagagcacgctggcttcctagagactggttggcaaacgtagaattaagaggatggtgataagaaaccagggatccatggggcagccttcccagtttgctcaaacattctgttgccaggctgtgaccaggactcagagaccagtcctaggtttaccatccagacaacaatgtgggggagcagagagagcgttatagagaaaagtttaaaaatataagtaaaatgaaatagtattcttgggtattaaaaaaagaactctgaggctaagattattgttggcctctggacttgccctttctggtctatcttccacattgctgtccgagtgaatcattccaacactgtatggcactctcttgcttaaaatctttcagtggctctctactgtgctcaggatcaagtgcaggtttaaagtgcaggtttattacctggtctgcctagccccatcttttgttatgcttttgtatgctctatctcggcctactcaacaatctgcagtgcctcaccctctggcctctaggtctttgagcacagtgtccccactgtctggtacactgctctctatattgtgtttggcgttccctttttctccaggtttaagcttggctatcactttctcccagaagtcctcctgtgtgctcccataatgcatacagctcctcctatgtgctctgtgcttggtcatagcacttatcacattaataatagtctccttcagagtctcagcaattggggtcaggcactgggtcttactgtggtcctagcatttagcatagggcctgccactcaggatctcaggtggttgttgaatggttaaattgtggatctataaaggcagaactgagcaaaattactgccttggtgtggtggtgacagtaactggaaatctctgtcaatgattccctacatgtggacttgatatttgagtccacaaaaattataatggaactactgtatatctttaaaaaacttgtaacaaaaatggctcatttatctaagacaaatccagacagactaataacaaagggtaaattgtttgcctttggctggaagataagctcagacagtgcagggttttctgctgatcagcagctcagattgcctcatgatgcaccacagggatttctgagataagattgaccagatcatctagtaatttctgatttactacaaaacatatcacaaatgaaaggtgcccatgaagttttgtgagaaaacttggaacctaggcccagatcattcattatggtgattagtactgcttttgtaattgcctgaattagcatgtctcttagatgagggacctgagccaagaaagaccttagaagtctgggaggtttgaaccagagacccaacggtcttgagaatttgcctaggaccaagaccagattctcaagatgctttctgtgtggtaggaaataagattatgactgttttatggaaacaaggagctaagtaaagttaggcacatccaagaagggcaaaactgttactttaggagaaggggcttggaagctcagttttgttgctttggttgggattttcaagatcggaaacatttttatgctgtatatattttggggattttttttcaaaagtaaaatatttcttctcaaaagtagattctgtgcttcagaatttaattaccacaaggagtcagaaaatcaacactacaatccagct

SEQ ID NO: 6863 - DNA, 2436 bp, Homo sapiens
agtagcgcagcgagaaggatcgccatcacacggcgcactggtgcggcttctcccccgagtggatgaacatgtgcttggtgtcgtttttccttgagctgaacgtcttgcaacagtggccgcacgcatagctgccccagatcccggaagaaaatctctcccacaccactgtagtcagagaggccagtgggtgcatggaactcctcgcacgcgctgtcagcagcagcagtgaggaagccggcagcacagtctgggaaggaaggaggtgcttggctctctcccgggccgccaccttcgccgtcctcgccatcggtctcatcgtcagtttcctcgtcatcgttgtcacctcggtcgtcaggggccgcggacagtgaggggtaggcaccaagcccctcggctttggcaggtgtcgggggcgcaggcagctgcaaactcgcgggccggcgctgcttaccgctgtgcgcggcaccggggtgccccgggggtgcgcagccagcaggtggcgcaggcggtgacgcagctgctcaggtgcgagtggcgggggcacaggggtgggcaggggcgcgggtgcagaggtgctcgcgggtgcagaggagcgcgtgcgataatctgcgtgcattcgtcgataactgtctatgcgaagcaccgacgcagccatgagtacctgcggggcttcactctgtgccacaacgagcgaaccgctgtacaggagctcgactagctgtcgcaccgtctgcacaggcaccaccgaaggcacacggatctcagaggggccgagcagcagcttgtcttggaaggagggcgagccgattgccagcccgcagcggtgcgcacgcagcgaagcttcatgaatgcacacagtcacgtcgcagaagtgcccacccagcttctgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactacgtacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatgctgatgatataaactggctcatttgatgccaagactgaccatcaccaccataccaaggtcatcactgatcagaggcctaacccaaggagggggtcatgtgcagacccagctgtggggaggaaagatgctgcagaggagacggatgcccacagaggcccctgagtggatacaatgctcactaagtgggctgaccccacattggacaccgctgcatccatgtccatcacacaacacagctgccgtttcttctgcctgcttatgggaaagtcccctcttctcctccgttttcttctcttcctgccctatcacaccgtgcacttctccctttccttaaagaaccaccatcaactttaggaggagggaaaggggtggctctggcaggaaaagccagaatcccctctagccagcagagagagagaggaatggctgcatgttttctcccccagtccaaggcactgggtcttggctgggttgaaggttccaagctgctctcctgctgtgtcggtgagttctggtcaacctgcaacctcctgatatggccattgcagttcatcgagtcttcagggactccccatggcctggagtactttgccttgcttacacgggagaggagaatggatttatagagaacatcatctaaatccaacttgaccattgtgtggccacacttgctagattgctatagtctaaatctagcattgtagaaagacgggggagcttggagctgcacaaacccaggtctggaactggctccttaccttggaaggtgaatgatcctgccaggactcttagcctccctgggtctcaatttctttatctgtttcatgggaatgaggatctctgctgggtggttgggtgatgtgggggctgtgtgaaaacagcttgtcaatacaagccaaaatagaaatatttctccacagagtatgaaggtcaaatgagagaatacatttaaattaaatggaaaattaaaatggtaaaaaatgcaaagctgtattgaaagttccgagcttctctataaggagctttttgactatggaagaatcctgtactcgttccccctaaatat

SEQ ID NO: 6864 - DNA, 2559 bp, Homo sapiens
caaactcctggtctcaagtgatccacccaccttggcctcccagagtgctgagattacaagcgtcaacgactgtacccggccccaaattccttattgaggatcctagaatacatgagaccagacttggaaatgaaagtgtaacatgtttattgttcaaaaagaaaaactcaaaggtgtgtagtgattttaaaatttagggaaattcctcaatatagtgaaagaagaaaaacaagaaagaaatttaggaaagaaacacacttaaaccataaaaaatagaaaatggaccaataaagataaaagctaaacttaacaaggtaggaaaaagaaaaagaataaattaaaaaattctttgaaagcaccaataaaatagataaaacctcctgagcctgataaaaggggaaaggagccaaaaaaattaacaaaattaggcatgagaaattagacataaccatatatattgaggaattgagaagaagaatagaactctatggcaacaaatttgaaatcagaggaaatggataatttcccagcaaacactgatcctagaaatagtttgaataggccagttggttacccaagaagaaactggaaaggtggttaaaattttatcctttttgagcaccataagatggtgaaaaataaataaaattttatccttgtaaaagattgatggccaggcatggtggtggcccacacctgtaatcctagcactttggaaggccaaggcaggcagatcacttgagccccggagtctgagaccagcctgggcaacatggcaagaccccacctctactaaaaataccaaaattagccaggcatgatggtgcttgcctgtagtcaacagctacttgggaggctgaggtggggaagatggtttaagcccaggaggcagaggttgcagtgagccaagactgtgctgctgcactccagcctgggtgacagagcgagaccatgtcccaaaaataaaaaattgtttttaattaaactttttaattgaaaaatatatgggaaattgtacaaatcacaagtatgcagctcagtgaatgattacaaagtaaacacactcctatagccatcactcaacccccaaaatagatgagttttaactattattgtactcaaacctgataaagtgccagaaagaatgctatagcctaatctcacctatggccatagatgcaaaaatcccaaataaaatcaagttgaattgcacactctgattacataaggtttattttagcaatgcaaggctcagtgtcaggaaatttattaatttattacatcaagaacttaaatgttatttaaatgtctagagagtgctagtgttgttaaattttctcattttgataattatactatgattacagaagagaacgtccttgttttcagaaaatgtaagtatttagaggttaaaggtaaacctctaatttggtttgccagtatttcagataactacacacacacacacacacacacacacacacacggaatgataaagcaaaaagtaaggtgttggcaaggcatggtggctcacacctgtaattccaacactttgggaggcccaggcaggtggatcacctaggtctggagttcgagaccagcctggacaacatggtgaaacccctctttattaaagtacaaaaattagccggacatagtggcacatgccggtaattccagctatttgggaggctgaggcacaggaatcccttgaacctggaggcagaggttgtagtgagcctacatcacaccactgcactccagcctggatgacagagtgagactgtctcaaaaacaaacaaaaaaaagatgttaacatttgggaaatctgagggaatgatgtacatgaattctttgtattgtttttgcaacttttaagtataaagttatttcaggccaggcatggtagtgcatgcctgtatacccagctactcgaggctgaggtggaagattccttgagtctaggagtatgaggttacagtgagctatgatcatgccactgcactccaggctgggtggcagagtgacaccctatctcttaaaaaaaaaaaaaaaaaaaaaaacaggtgcagtatctcacacctgtaatctcaacagaacactgaggggtcaaggcaggtggactgcttgagcccaggagttcaagaccagcctgagcaacatggtgaaaccccatctctgcaaaaaattagctggttgtggtggcatccacctgtggtctcagctacttgggaggctgaggtgggaatataactggagctcaggaggtggaggttgctgtgagatgagatcgtgccactgcactccagcctatctccaaaaaaaaaaaaaaggctatagtagaagcctattagcatggataagtgtctgaataaaagataactgtacaaaaatcaattgttttttctgtattctagcaataatcaactagaaacagtatcaaaagaaaaacattccatttacaattgcaacaaataggtatatatatatttgctcttctacacataacctatttctggaagggagcagaactgggcaattcagggacagcaatggaag

SEQ ID NO: 6865 - DNA, 3720 bp, Homo sapiens
aacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaaggtacatttcccaagaactgctatggatgatgcatgctctttcgggtttgctgtggttcttcttggagtttggtctgaggacagagctgagaagaggagaagctctttctcaagaagtttctttctacctaagaggggtctgtcaactcagaacatttccgggtgggactccctttaggaagatgcatgtcaggctttttcatcttctttcaagcctggaattagtttgttcctgttggaggtgttatgcatgagtacacagtttgttgctttggagttttgtttttttcaaatgtctgtatataaggctgagacctcccctggaaattctgctacttgttaataattcctttttcttcaccctcatgagctgaaaactgcattttaaagaaaaggtatttctcaggatgtggctggttcattgaacactttcttaggtcatccatgtagtgacaggagctattaggaaggagaactgtgactctgagagatagagagccaaagaaagtgagagacagacagactggctgtgggatgagagcctcagaagccaccactctcccctgtggaaatgaaggttccattccatgtgcagctgtgttttttttctgatgcactttcctaaattaataatgtggaggtggaggtgagggtggattttaaatgaatcctatagggggaattatggcttatgtatgtatttttttccatttatagcatggcagagggatagacttttaaaaggtttataattgctcttactcctctgctgattttttagaaaatcctgtcagtcatctttgatcagaacatatttaggtaaatttctttctgaagagatcatgaaactctagattctaaaatgcgtggtgagaagtaattgtagtggatgaaggcttgggctttcataaagtgaggagatgccactccagctggacgggctcgtggagtctgcattcgagggattccctagtccgtccagtcatcacgggctgctgcccgcctgcccgtgccgtccaaggcacctggccttgggccggtatcaggtagccgcgcctgggtcacacctgccctccacgttcatctctccacctacagatcatagggaccgtttcctcattttattgtcatgcaaatgttgtacataaatacatggctataaacaggcagctcagagtaaccaggaggctcttttctcagtgacagatcacaccctcttagagtagtaatttttgaataattgttgcaaaatatgaaaacctttagcaaaactccagcaccactgaagtcatcaggaagtgtttgggagaatacgtgtctgtgctggatgctgttgaagcaggtcaggccgttggggtcccttcgttcttagggcttctccaccagcttctaaatggggaatgccaactttgtgccaggcacacactacctgctgagacactgtggatgaacaaggcgttgacccagggctcactctgtagaggaagaagaccagagaatggataccaccaagacagtgataagtgctgcaacagggttcagagctgcacaggaagtccccaaaggtagtgaacccatcatcggggcttaggaaagagcttttaaaggaagataaagccagcaggtgacgccaaaaactgggtatttctgtagggtagcttttttccctttcgttctacttgttgtactatacagtagagtagccaacccacctccaaggaaaataaaattcaaaatatataatgtaatcagtatgatgatagctcttattgttttgcttctgtacttcaagctgtgaagtcattcttgtaacacaggctgaattttccccctcaaccatggtgtttaatgagtgtgaatcttcattcaaccattaaaatctccaagagtatttttatactaacagttcacaaacttgaggcaattatagtctaagtagattccaactcctgcccccacccgtcttcctgccaccaccgccgcccggtctctggaggatcttggaaagaatttaccagcctttaggaacattcagcactttaaaagtgtcacagagccataaataaagagtaagacacccctaagactgtcatctcatcaccacacccgtctctgctgaggaggacagagacaggaaggaaatgcgacaagttcactgtgcagtagccaagcaggcccagccaacatgtgggagggtgggtgtctgtcccagcggtggggcaggaggcgtgcaggggaaggggctgcctggaggtaaggctctgcggtcagccagccctgggtttggtgctccaggaaaggccagcacgtaggggagtgaggtggggtgctgctgttggtagggtaggaagtgacctcgcagggtggggccagggcttcgtggccagtgggcggccatttctgtgacattgcaatgttctgcgtggatcgttttctggattcctgccaaggtgtttacttggcctggggaaagagaggaacgcatgaggggcccagaccttgccccctgacccatgatagggtctttgagggcatacataacacatctggagcttaaaaagaattaaactgtagaaataagacttcagtgaaggataatatattagtggaggaaagaccaaatggaagatggtgttaaccatcccacaaatagaaatgagtgttatattaggagcctaaggtgggacaaccacacttccccagagctctttaaaaatagcgcagacactcatgcctctagtatgattcagttcagctcctcattgaaccagggaagagaccgacagacttcacaccacttcttctgttcctgtaattctccactgtgcagcttgggatttcctggagatgtttccataaaaatagagagatgccatcatcactgtcgtcactgtcactgctgtacaataataaaagaaggtgctaggatgccttcctgtaagttttagactagatgtattaaaaagtatccggta

SEQ ID NO: 6866 - DNA, 706 bp, Homo sapiens
ggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgtgagtgctcagccctgtagtggacaggaggcaacagaacttcagaagggaaggtttcggtagcagtctgggaattcaaacatgaaattgagtcaggggtttgccctgtggagaaggcttatctagccaaattagggaggcagcaccccttcctcatagtgaaactgaagttctgaaaagtggaatctggagcccagcaaccgaaagatcattgcaattatagccgcatgtttctgggcatctgctttgggccaggcactgtactaagctctttgcaagcattatctcattctctaaaggccttactctaacttgtaaggaaggcattcttgtttccattttattcaaggagactgcgaagctcaaggaaattagctaacttcttgtaattactaaatatataggagggtggcagatctgggaatcacatctctgactccaagcttatggtgatcattatgccggccttctccacgagtggagataggaggaacgtggtctgtg

SEQ ID NO: 6867 - DNA, 557 bp, Homo sapiens
tgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatggtaagaattacataaacattggttgaaaaaagaaatgtctcattttcctatgtaaatctaagtcgttttaaacattttttgattaaaattaaaagtatttgtcatgtga

SEQ ID NO: 6868 - DNA, 2612 bp, Homo sapiens
cttggctacaagtcttcaatataacgttttcaattttttccctttcttttttctatttttcctaatttggagtcactgaaagctaagctgtgctttgtgaagccctgtgaactgaagctagacaacttaaacttcagaagaaaataacagcaacctgtttacatatataagctactttcatacctgcctactgatgtatggacttcagagtagtgtggcctatatcgattttctaggatcattattttgtttgttgtttttctcccttcctccacctattttctcttcataggacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgagggaacgcagaacgctctggcaccttcaacagacttgccccttggggagctctggagacagccacagcagcgcccctggagacccccggctgaagggacagcagcgagaggcctccccacaaggagcctgacagcggctggactgaagactgtgagggagctgagccacagtgcatccaagctgctccaggtagtcccagaaacaagtggaggtggtgggagatgccacgtggctgggctgagatcctgagtcagcaggcaggtgcagggagacagaaaattaaaatgtgacttttatgttgatgtaaccttctttagagccacaggctggggcttaggcacatttggtaatagaagacatcgcgcttccatccacaagcaaggaaaatacacaaaaatacacaaaactctcaggaatatcttctattattatctcacacatgaaaaaagatcttcggaggttttagaaagttatctgagagtccctctccctctcccgctccctctccccacggtctccctctccctctctttccatggtctccctctgatgccgagccgaagctggactgtactgctgccatctctgctcactgcaacctccctgcctgattctcctgcctcagcctgccgagtgcctgcgattgcaggcgtgcgccgccacgcctgactggttttcgtattttttttggtggagacggggtttcgctgtgttggccgggctggtttccagctcctaaccgcgagtgatctgccagcctcggcctcccgaggtgccgggattgcagacggagtctcgttcactcagtgctcaatggtgcccaggctggagtgcggtggcgtgatctcggctcgctacaacctccacctcccagccgcctaccttggccgcccaaagtgccgagattgcagcctctgcccgg

SEQ ID NO: 6869 - DNA, 523 bp, Homo sapiens; identical to SEQ ID NO: 2137

SEQ ID NO: 6870 - DNA, 809 bp, Homo sapiens
cgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaagg

SEQ ID NO: 6871 - DNA, 665 bp, Homo sapiens
cggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacagggtggcgccaggctgccatagcagcaagtccgattttcctccatcagctggcccgcccagcccagccagcccgagaagccgcagctgacagctagctccctgccgactctgccttccctccgaagcagtggacgtgctgataaatgtttaccggtgctctctttaaaaa

SEQ ID NO: 6872 - DNA, 1668 bp, Homo sapiens
tcagaatacagtctgttgaattatcctagatgaaaataaaggcaaaccaacacattcatccatgaggattttggtccattccatttattttcttttattttgcattcttaatttcctttttagtttaacactgtttgtttgagcttagggaagacaactaccaagaaaggccaggaacagttgactacacaatgaagattccatgcaaaatgttcaatattggatctaaaggggttcaaaatgtttcatactaaactgtttgggaatttatttgttaactctgtgtacacctaataaaattcaatgttttcttctcagaagagttcattgagaccaaactgaacctcatttattgaaaattatatgtgggatcaatgtactggcctcttgttattctttctatgtgggaggatgacccagtcatcattttccccatctgcactgtatttattgggaaattattttgtcactgctttcataaatcttcttcatgacagcccttgcccagcattaaaaaattctggcctgcttagctgattaaaggtttagtagaaatttaactgtttgtttatgcttatttcattttcatattggattctacttgaataaataaaaagttagcagaacgtttgagtagatttattgccaatgatgctaaattacaaatctaacaaacaaaatgattcctttggtcatttttgatttggtgttatgtcatcttgaagcctattgtttttaacaggaacagttaaaatatattagataacttccattaaccaattattttcagaaaacatagatcccataatatgtggccaactatatgagtaattaactaacttgtaatacagtcaaatgggcttatggacactacttacagcagcaacacttcacttcacacaaacacacacatatacacacacacacacacacacacacacacacacacagagcaaacacccccatctatttgttactgataattagccctacttgctggtttctttttcccctgcaagtctgtttattggtttaaattaagacaagatttatttttgtaaatgactgagatttatgtaaatgtgtatctctgttgtgttttatatatggggtgtctataagggcatttatccctatgaaggatgtcaaatactttcttctaatatatgtttagacatattgcagaggggtccttgttatttgtaattgagttaggtcatttactttgtgtctggtctcacctgtagcatgggaagaggacagcaatgatgagctgcatgtagtaggtacctgtgtatcaagaactgttggtatgtattgctaatttgcatacaaagagtttgtctgtctgcattgtagtttgtgtttaatatcatttgttaaattcacaaatacaacatattgaataaaatatttatatgaaggcatattaaaaaacatcaaacaactttatgtaacaaaatggcattgcattactcaccaatatagagaaatgtcatgtaaataagttggtaaactcaatttccccctttaccatgccaaagaaaattttagctctttgatgatacctctcttgctatttgtttgggataagacttcgccatttttttcccctcagaaattaagtttgctgttattaagtaagaagtgcaatctgtcactactgat

SEQ ID NO: 6873 - DNA, 1433 bp, Homo sapiens
ggaagtgcgtaccggaagtgccggcggcagtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcatgta

SEQ ID NO: 6874 - DNA, 5105 bp, Homo sapiens
cgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcaggtttttcccagaccttctcctgtcccgcgttccccctaggccggccgtagggaccagaccccaccctaagcccatagccggccttcgcgctccgggtgaccctggctggccctgtttgtctgtgggtcctgggatgcgccactcccggcaggaaggggcgccgccgaggcccggtctcagcctggaaccccgctcctgccgtcggggcgctttctgcggctgcccacacacgaccccaggcaaggggtgggggcgcgggaccctccatgacatggcggcggggcgctctcacttctttgaaaccagcgtaaactggacccgccccacctcccataccttgggggagccccgggaaaggctgtggcctgggggtctgcagggcgttggcagtggaggtggggagagaccccagccctttcctgtcccccccaccagccttgccttcctcgccgtgagccggggacagtggaggggagtcagggagggcccaccagatggactttcttgtgactcatcctataaagcccctcgggcttagccaccctccccaggacccgtgtggtctcccggactgtgctggaagcttagagccagaatgacttttccaccctcgggctggctggctcagtgggcagcagggacagggggctgtgaagagaaaactcactcgccagggtcaggggccgcttgctcactgaggaaagcagaggggttcctgccgcttgcctcaggaacaaagctagttggtgaggcactgccttgcagttgtaggagaggaataatggcccccgtgggtgcttggttggaacgattaaaggagaataacagtttagcacgattatttcacacagttgttcaaagagatggctttgaattccagcttacatggcgtcttcaacaaaaagtaattgtttagagaagtgacaagatgaaggaggactctgagtcctagtctccctcctcgagtccctgtgtgagcagaggtaaacaatgaaaactcaccaaccaggagaaattcacctaggactggcgcagaaggtatacaccatgagcctggaaatgatttaaaaaacaacacaggctgggcgcggtggctcacacctataatcccagcactttgggaggcagaggcgggcggatcacttgaggtttgcgagttggaaaccagtctgaccaacgtggagaaaccccgtctttactaaaaatacaaaattagccaggtgtggtggcgcatgtctgtaatcccagctactggggaagctgaggcaggagaatcccttgaacctgagagatggaggttgatgtgagctgagatcacacaattgcagtccagcctgggcagcaagagtgaaactccatctcaaaaaaacaaaaaaaacaacccacaactgtgggccaaagggacacagcgacaaggggtcccaatgggcgaggctggaataacttgaatagcagaataaagtagcattggattataatgcacagggctgaagaaatatcgatgagtctttgctgatgtaataagtgactgaatgagctgggcagagtgggacctgtagttcagctactcagaggctgaggtgggagcatcagttgagcccaggagtcaaggcctagtaatatcccatttccaaaataaaagactgaattaataaatagatgggagagaggagacaattgaccatgcaggaggagtccaaatatttgttctttgaggcaggatcttcctctgtcattcagaaggctggagtgcaatggtgcgctgttgccttgctgcagcctggacctcctgggctcaggcagttgtcccacctcagcctcccaagtagctgggaccagaggcatgcacatccagccgagtccaaatagtgtatgcagatatgccctcacagaggtgacctgaactttctgagttgtgagtgagcttcacctggggacctccttttaggtagcagggaaaaagaggagggtgagccacacccaggcacctccttccagagagcatgtgcctcagcctccagagtagctgggattgcagacatgtgccaccagcccgactaatttttgtatttttagtcgatacgggggggtctcactatgttgcccaggctggtcttgaactcctgggttcaggtgatcttcccacttcagcctcccaaagtgctgggattacaggtgagataaaacttccttattcacagactacatgattgtctatatagagaacactcatctaaagcaacagcaatgattgccacaaagaccctcgtagagccagtaagtgagtttggaatgttcaccagtaacacatacaaattaatcttagggctgcgtgcagtggctcatgcctgtaatcccagcactttgggaggctgaggccgaggctggtggatggcctaaggtcaggagtttgagaccagctgaccaacatggtgaaaccctgtgtctactaaaaataggaaaactatccaggcatggtggcgggcactgtaatcccagctactcaggaggctgaggcaggagaatcgcttgaatccgggaagcagaggctgcagtgagccgagatcgcaccattgcactccagcctgagcaacaagagtggaactctgtctcaaaaaaaataaaagacccggtgtggtggctcatgcctgtaatcccaacgctctttgggaggctgaggcaggcgtatcaccaggtcaggagttggagatcagcctgaccaacatggtgaaaccctgtctctactaaaaatacaaaaattagccgggtgtggtggcacacacctgtaatcgcagctactcaggaggctgagacaggagaattgcttgaacctgggaggcagaggttgcagtgagctgagatcatgccacatttgaacccgtgaggcagacgttgcagtgagccgagatcatgtcactgcactccagcctgggcaacagagccagactgtctcaaaaaaaaaaaaaaaatcttacttctatagacaataaaacattggaaactgaagttaaaaacacagtagctcctgagagagagagagaggtataaatctaacaagacaaaacaggatctgtatgctaaaaagactatgtatgtggagagacggcacacagcacgctcatagactggaagactgaacataagatgccagtctcagaaggatctgtgaaattaacaaaattccaaaacattgcagtaggactctttttagatttagaaaagatgattttaaaatgtatacagaatggtgaaggagctagctaaaacagtaaaaaggatagataaaacaatgttttaaaaagaacaaaaaagttagatgaatcacattacacagttttaacagactttaaagccacaaaaatcaagactgtcgtattggcaaagaacagacagatgggtcagtgatcagagagtctagaaacagacccacataaatagggccatttgatctttgacagcagtgcaaacaaaagcaaccctgtggagaaaggattgtccattcaacagagcagtggggcagttggtcatccatatggtagaaatggaaccttggcctaaacctcacattgtacacaattaactccaatcatatgtaaacgtaaaacaaaactataaaatgtttggaagaaaacagaaaaatacctttgtacctgatgacatttggtagagttcttagacatgatcccaaaggcataatccacagaagaatccataaaagaaaaatttgtaaattggactttatcaaaattaaaaacttacttttttgagatagggtcatgctgtgttgtccaggctggagtgtggtggtaagtcatagttcactgcagcctcgacctcccgggctcaagccatcttccttcctcagcctcctgagtagctgggactagaggtgcaagccactattcctggttttaaaaattttttccagagtctgagtcttgctgtattgcccaggctggtctcaaattcctagccttaagtgatccttccaccttcggccccaaagtagttgagattacaggcatgagccaccgtgcctgacctaaaaacgtttgaactaccaaagacagtgtgaaaagaatgaaaagatgaggagaaaatattcacaaatcacctgtcaactaaggacctgtatttggaatacacagagaactcttaaaactcaacagtaagaaaacagtccaactaaaaagtggaaaagacctgatcagacatgcaccagcaatgacacagcattgactgttgggcacaggagaagaggcttgacaccaccagccaccaggaaatgcagattcagccaccacgcaggacacgaggcacctgcaccacagccgcagtgcaagagaatgctggtggtgccccaagctgccagggtgtggacctgctggaaatggaagacggcatggtggtttcctataaagttcaatgtacacagccacatgacccagcaatcccactgttgggtatttagagaatgaaaaacttaagtccacataaaaactgtacgtaaatgtttactgatgccttattcataatcatcaaaagctgaaattcaaatgcctttcattgggtgaactggtaaactgtggtatatctatgcagtgaaatactcctctgcagtgacaatggggagagactgacacattgggcaccatgggggtgggaagaggtgaaggaaggttgggggaaggcgccgtggtcaggtgtggcactaaggagatttgggggtggagccattctgtgtgtggactgtggtggtggtcgcgtgactgtacatgtgttaaagcttcaaacaaaaaagttaaaaattttagtttaaaatattaaaacatttttaaaaatgg

SEQ ID NO: 6875 - DNA, 300 bp, Homo sapiens
aggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagagtaaatgcagcccatccagaatcctggagcaataaagtaagaagtaattcaaa

SEQ ID NO: 6876 - DNA, 444 bp, Homo sapiens
atggcgctgaaacggattaataaggaacttagtgatttggcccgtgaccctccagcacaatgttctgcaggtccagttggggatgatatgtttcactggcaagccacaattatgggacctcatgacagaccatatcaaggcggtgtattcttttggacaattcgttttcctacagactaccccttcaaaccatctaaggttgcatttacaacaagaatttatcacccaaatattaacagtaatggcagcatttttcttgacattctaagatcacagtggtcgcctgctttaacactttctaaagttcttttatccatttgttcactgctatgtgatccaaacccagatgatcccctagtgccagagattgcacggatctataaaacagacagagataagtacaacagaatatctcgggaatggactcagaagtatgccatgtga

SEQ ID NO: 6877 - DNA, 713 bp, Homo sapiens
gtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactggggtgagacagggccctggagttgatgtgggggcttggggaggggtttaggaagggagaaagaaatagaaatgggaatgggaggccctgatctttgctttttgttcttgctttctccttaacatatacatctttctaaattgcaatttccctgaatgtgagcagcaactcctctctccctccatcctctggctctttgcctggggatctcctgtgggcccatctctctggttcctgtttctccttgtggctttctcatggcctctacctacccaccccagtcatccc

SEQ ID NO: 6878 - DNA, 4440 bp, Homo sapiens
gcggctgctggtcccgggcgcgcggagggcgcgagcggcgcgcgggggccgagggggcgcgaggcagcggcgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaatgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaagaaact
